US008735111B2

(12) United States Patent
Vanhercke et al.

(10) Patent No.: US 8,735,111 B2
(45) Date of Patent: *May 27, 2014

(54) PROCESSES FOR PRODUCING HYDROCARBON PRODUCTS

(71) Applicants: Thomas Vanhercke, O'Connor (AU);
James Robertson Petrie, Bywong (AU);
Anna El Tahchy, Scullin (AU);
Surinder Pal Singh, Downer (AU);
Qing Liu, Giralang (AU)

(72) Inventors: Thomas Vanhercke, O'Connor (AU);
James Robertson Petrie, Bywong (AU);
Anna El Tahchy, Scullin (AU);
Surinder Pal Singh, Downer (AU);
Qing Liu, Giralang (AU)

(73) Assignee: Commonwealth Scientific and Industrial Research Organisation, Campbell (AU)

( * ) Notice: Subject to any disclaimer, the term of this patent is extended or adjusted under 35 U.S.C. 154(b) by 0 days.

This patent is subject to a terminal disclaimer.

(21) Appl. No.: 13/725,404

(22) Filed: Dec. 21, 2012

(65) Prior Publication Data

US 2013/0164798 A1   Jun. 27, 2013

Related U.S. Application Data

(60) Provisional application No. 61/580,590, filed on Dec. 27, 2011, provisional application No. 61/718,563, filed on Oct. 25, 2012.

(51) Int. Cl.
*A01H 5/00* (2006.01)
*C12N 15/52* (2006.01)

(52) U.S. Cl.
USPC ............ 435/134; 435/166; 435/440; 435/468

(58) Field of Classification Search
CPC .............. C10L 5/44; C10L 5/40; C11B 1/04; C11B 1/02; C11B 1/06; C11B 1/08; C11B 1/00; C11B 3/006; C11B 3/16; C11B 3/12; C11B 3/02; C11B 3/00; C11C 3/003; C07C 1/147; C07C 1/00
See application file for complete search history.

(56) References Cited

U.S. PATENT DOCUMENTS

| | | | |
|---|---|---|---|
| 4,948,811 A | 8/1990 | Spinner et al. | |
| 5,500,361 A | 3/1996 | Kinney et al. | |
| 6,100,077 A | 8/2000 | Sturley et al. | |
| 6,344,548 B1 | 2/2002 | Farese et al. | |
| 6,432,684 B1 | 8/2002 | Mukerji et al. | |
| 7,045,326 B2 | 5/2006 | Cases et al. | |
| 7,109,392 B1 | 9/2006 | Broglie et al. | |
| 7,135,617 B2 | 11/2006 | Lardizabal et al. | |
| 7,417,176 B2 | 8/2008 | Lardizabal et al. | |
| 7,589,253 B2 | 9/2009 | Green et al. | |
| 7,741,532 B2 | 6/2010 | Lardizabal et al. | |
| 7,807,849 B2 | 10/2010 | Singh et al. | |
| 7,834,248 B2 | 11/2010 | Green et al. | |
| 7,834,250 B2 | 11/2010 | Singh et al. | |
| 7,932,438 B2 | 4/2011 | Singh et al. | |
| 8,530,724 B2 | 9/2013 | Whitelaw et al. | |
| 8,535,917 B2 | 9/2013 | Singh et al. | |
| 8,575,377 B2 | 11/2013 | Singh et al. | |
| 2002/0104124 A1 | 8/2002 | Green et al. | |
| 2004/0221335 A1 | 11/2004 | Shewmaker et al. | |
| 2005/0106697 A1 | 5/2005 | Cases et al. | |
| 2005/0262588 A1 | 11/2005 | Dehesh et al. | |
| 2006/0053512 A1 | 3/2006 | Bao et al. | |
| 2006/0094088 A1* | 5/2006 | Picataggio et al. | 435/134 |
| 2006/0206963 A1 | 9/2006 | Voelker et al. | |
| 2008/0268539 A1 | 10/2008 | Singh et al. | |
| 2009/0061492 A1 | 3/2009 | Benning et al. | |
| 2009/0308041 A1 | 12/2009 | Whitelaw et al. | |
| 2010/0184130 A1* | 7/2010 | Koprowski et al. | 435/41 |
| 2010/0221400 A1* | 9/2010 | Chapman et al. | 426/417 |
| 2011/0015415 A1 | 1/2011 | Singh et al. | |
| 2011/0054198 A1 | 3/2011 | Singh et al. | |
| 2011/0190521 A1 | 8/2011 | Damcevski et al. | |
| 2011/0218348 A1 | 9/2011 | Zhou et al. | |
| 2011/0223311 A1 | 9/2011 | Liu et al. | |
| 2011/0229623 A1* | 9/2011 | Liu et al. | 426/601 |
| 2011/0314725 A1 | 12/2011 | Petrie et al. | |
| 2012/0029252 A1* | 2/2012 | Lissianski et al. | 585/240 |

FOREIGN PATENT DOCUMENTS

| | | |
|---|---|---|
| EP | 1806398 | 7/2007 |
| EP | 1837397 | 9/2007 |
| EP | 1944375 | 7/2008 |
| WO | WO 98/55631 | 12/1998 |
| WO | WO 99/49050 | 9/1999 |
| WO | WO 99/67268 | 12/1999 |
| WO | WO 99/67403 | 12/1999 |

(Continued)

OTHER PUBLICATIONS

Chappell et al., "Vegetable Oil Production: Industry Profile," Preliminary Final Report, EPA Contract # 68-D4-0099, RTU Project # 7018-54 (1998), pp. 1-1-5-26, retrieved from http://www.epa.gov/ttnecas1/regdata/IPs/Vegetable%20Oil_IP.pdf, Apr. 23, 2013.*
Endalew et al, Biomass and Bioenergy (available online Jul. 13, 2011) 35, 3787-3809.*
Chappell et al., "Vegetable Oil Production: Industry Profile," Preliminary Final Report, EPA Contract # 68-D4-0099, RTU Project # 7018-54 (1998), pp. 1-1-5-26, retrieved from http://www.epa.gov/ttnecas1/regdat/IPs/Vegetable%20Oil_IP.pdf, Apr. 23, 2013.*
Endalew et al, Biomass and Bioenergy (2011) 35, 3787-3809.*
Slocombe et al., Plant Biotechnology Journal (2009) 7, 694-703.*
Parthibane et al., J. Biol. Chem. (published online Nov. 2011) 287, 1946-1954.*

(Continued)

*Primary Examiner* — Karlheinz R Skowronek
*Assistant Examiner* — Catherine Mader
(74) *Attorney, Agent, or Firm* — John P. White; Gary J. Gershik; Cooper & Dunham LLP

(57) ABSTRACT

The present invention relates to processes for producing industrial products such as hydrocarbon products from non-polar lipids in a vegetative plant part. Preferred industrial products include alkyl esters which may be blended with petroleum based fuels.

24 Claims, 20 Drawing Sheets

(56) References Cited

FOREIGN PATENT DOCUMENTS

Figure 1:
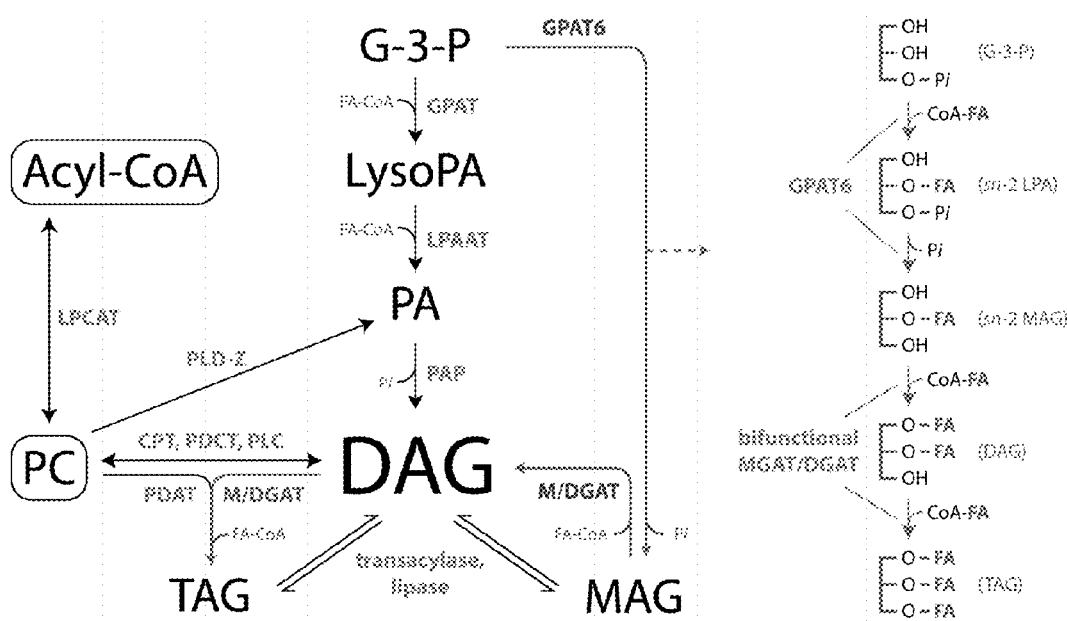

| | | |
|---|---|---|
| WO | WO 00/01713 | 1/2000 |
| WO | WO 00/11176 | 3/2000 |
| WO | WO 00/32756 | 6/2000 |
| WO | WO 00/32793 | 6/2000 |
| WO | WO 00/36114 | 6/2000 |
| WO | WO 00/60095 | 10/2000 |
| WO | WO 00/66750 | 10/2000 |
| WO | WO 00/66749 | 11/2000 |
| WO | WO 03/078639 | 9/2003 |
| WO | WO 2004/011671 | 2/2004 |
| WO | WO 2005/003322 | 1/2005 |
| WO | WO 2005/063988 | 7/2005 |
| WO | WO 2005/103253 | 11/2005 |
| WO | WO 2007/107738 | 9/2007 |
| WO | WO 2008/025068 | 6/2008 |
| WO | WO 2008/130248 | 10/2008 |
| WO | WO 2008/157226 | 12/2008 |
| WO | WO 2008/157827 | 12/2008 |
| WO | WO 2009/027335 | 3/2009 |
| WO | WO 2009/129582 | 10/2009 |
| WO | WO 2009/143397 | 11/2009 |
| WO | WO 2010/009499 | 1/2010 |
| WO | WO 2010/009500 | 1/2010 |
| WO | WO 2010/057246 | 5/2010 |
| WO | WO 2012/000026 | 1/2012 |

OTHER PUBLICATIONS

PCT International Patent Application International Search Report, issued Dec. 6, 2011 for the related application PCT/AU2001/000794.
Alemanno et al. (2008) "Characterization of *Leafy cotyledon1*-like during embryogenesis in *Theobroma cacao* L." Planta 227:853-866.
Alonso et al. (2010) "Catalytic conversion of biomass to biofuels" Green Chem. 12:1493-1513.
Andrianov et al. (2010) "Tobacco as a production platform for biofuel: overexpression of *Arabidopsis* DGAT and LEC2 genes increases accumulation and shifts the composition of lipids in green biomass" Plant Biotech. J. 8:277-287.
Barthole et al. (2011) "Controlling lipid accumulation in cereal grains" Plant Sci. 185-186:33-39.
Bligh and Dyer (1959) "A Rapid Method of Total Lipid Extraction and Purification" Canadian Journal of Biochemistry and Physiology 37:911-917.
Bouvier-Nave et al. (2000) "Expression in yeast and tobacco of plant cDNAs encoding acyl CoA:diacylglycerol acyltransferase" European Journal of Biochemistry/FEBS 267:85-96.
Burgal et al., (2008) "Metabolic engineering of hydroxy fatty acid production in plants: RcDGAT2 drives dramatic increases in ricinoleate levels in seed oil" Plant Biotechnology Journal 6(8):819-831.
Cases et al., (1998) "Identification of a gene encoding an acyl CoA:diacylglycerol acyltransferase, a key enzyme in triacylglycerol synthesis" PNAS 95:13018-13023.
Cases et al., J. Biol. Chem. (2001) "Cloning of DCAT2, a Second Mammalian Diacylglycerol Acyltransferase, and Related Family Members" 276(42):38870-38876.
Cernac and Denning (2004) "*WRINKLED1* encodes an AP2/EREB domain protein involved in the control of storage compound biosynthesis in *Arabidopsis*" Plant J. 40:575-585.
Dulermo and Nicaud (2011) "Involvement of the G3P shuttle and β-oxidation pathway in the control of TAG synthesis and lipid accumulation in *Yarrowia lipolytica*" Metab. Eng. 13:482-491.
Durrett et al. (2008) "Plant triacylglycerols as feedstocks for the production of biofuels" Plant J. 54:593-607.
Endalew et al. (2011) "Inorganic heterogeneous catalysts for biodiesel production from vegetable oils" Biomass and Bioenergy 35:3787-3809.
Ghosal et al. (2007) "*Saccharomyces cerevisiae* phospholipid:diacylglycerol acyl transferase (PDAT) devoid of its membrane anchor region is a soluble and active enzyme retaining its substrate specificities" Biochimica et Biophysica Acta 1771:1457-1463.
Gong and Jiang (2011) "Biodiesel production with microalgae as feedstock: from strains to biodiesel" Biotechnol. Lett. 33:1269-1284.
Greenwell et al. (2010) "Placing microalgae on the biofuels priority list: a review of the technological challenges" J. R. Soc. Interface 7:703-726.
Jain et al., (2000) "Enhancement of seed oil content by expression of glycerol-3-phosphate acyltransferase genes" Biochemical Society Transactions 28(6):958-961.
Jako et al., (2001) "Seed-Specific Over-Expression of an *Arabidopsis* cDNA Encoding a Diacylglycerol Acyltransferase Enhances Seed Oil Content and Seed Weight" Plant Physiology 126:861-874.
Karmakar et al. (2010) "Properties of various plants and animals feedstocks for biodiesel production" Bioresource Technology 101:7201-7210.
Kelly et al. (2012) "Suppression of the *Sugar-Dependent1* triacylglycerol lipase family during seed development enhances oil yield in oilseed rape (*Brassica napus* L.)" Plant Biotechnology Journal, pp. 1-7.
Lardizabal et al. (2001) "DGAT2 Is a New Diacylglycerol Acyltransferase Gene Family" J. Biol. Chem. 276:38862-3886.
Lardizabal et al. (2008) "Expression of *Umbelopsis ramanniana* DGAT2A in Seed Increases Oil in Soybean" Plant Physiol. 148:89-96.
Liu et al. (2010) "Producing biodiesel from high free fatty acids waste cooking oil assisted by radio frequency heating" Fuel 89:2735-2740.
Maher and Bressler (2007) "Pyrolysis of triglyceride materials for the production of renewable fuels and chemicals" Bioresource Technology 98:2351-2368.
Parthibane et al. (2012) "Oleosin Is a Bifunctional Enzyme That Has Both Monoacylglycerol Acyltransferase and Phospholipase Activities" J. Biol. Chem. 287:1946-1954.
Perez-Vich et al. (1998) "Determination of Seed Oil Content and Fatty Acid Composition in Sunflower Through the Analysis of Intact Seeds, Husked Seeds, Meal and Oil by Near-Infrared Reflectance Spectroscopy" JAOCS 75:547-555.
Petrie et al. (2012) "Recruiting a New Substrate for Triacylglycerol Synthesis in Plants: The Monoacylglycerol Acyltransferase Pathway" PLoS ONE 7:e35214.
Pokharkar et al., (2008) "Synthesis and Characterizationof Fatty Acid Methyl Ester by In-Situ Transesterification in *Capparis deciduas* Seed" Leonardo Electronic Journal of Practices and Technologies 13:12-18.
Sanjaya et al. (2011) "Increasing the energy density of vegetative tissues by diverting carbon from starch to oil biosynthesis in transgenic *Arabidopsis*" Plant Biotech. J. 9:874-883.
Semwal et al. (2011) "Biodiesel production using heterogeneous catalysts" Bioresource Technology 102:2151-2161.
Shiina et al. (1997) "Identification of Promoter Elements Involved in Cytosolic $Ca^{2+}$-Mediated Photoregulation of Maize cab-ml Expression" Plant Physiol. 115:477-483.
Singh et al. (2012) "Accumulating Triacylglycerol in leaves via the Monoacylglycerol Acyltransferase Pathway" 20th International Symposium on Plant Lipids.
Srinivasan et al. (2007) "Heterologous expression of the *Baby Boom* AP2/ERF transcription factor enhances the regeneration capacity of tobacco (*Nicotiana tabacum* L.)" Planta 225:341-51.
Vanhercke et al. (2012) "Maximizing lipid accumulation in vegetative plant tissues" 8th International Symposium on Biocatalysis and Agricultural Biotechnology.
Weselake et al. (2009) "Increasing the flow of carbon into seed oil" Biotechnology Advances 27:866-878.
Wood et al. (2009) "A leaf-based assay using interchangeable design principles to rapidly assemble multistep recombinant pathways" Plant Biotech. J. 7; 914-924.
Yang et al. (2010) "A distinct type of glycerol-3-phosphate acyltransferase with *sn*-2 preference and phosphatase activity producing 2-monoacylglycerol" PNAS 107:12040-12045.
Yen et al., (2002) "Identification of a gene encoding MGAT1, a monoacylglycerol acyltransferase" PNAS USA 99(13):8512-8517.
Abdullah, R., Cocking, E. C., & Thompson, J. A. (Dec. 1986). Efficient plant regeneration from rice protoplasts through somatic embryogenesis. Biotechnology, 4, 1087-1090.

(56) References Cited

OTHER PUBLICATIONS

Agarwal et el. (2003) "Cottonseed Oil Quality, Utilization and Processing" CICR Technical Bulletin No. 25, pp. 1-16.
Aghoram, K., Wilson, R.F., Burton, J.W., Dewey, R.E. 2006. A mutation in a 3-keto-acyl-acp synthase ii gene is associated with elevated palmitic acid levels in soybean seeds. Crop Sci. 46:2453-2459.
Almeida and Allshire, (2005) "RNA silencing and genome regulation." Trends in Cell Biology, 15:251-258.
Akagi et al. (1995) Nucleotide Sequence of a Stearoyl-Acel carrier Protein Desaturase cDNA from Developing Seeds of Rice. Plant Physiol. 108, 845-846.
Anai et al. (2003) Improvement of rice (*Oryza sativa* L.) seed oil quality through introduction of a soybean microsomal omega-3 fatty acid desaturase gene. Plant Cell Rep. 21,988-992.
Ascherio and Willett (1997) "Health effects of trans fatty acids" Am. J. Clin. Nutr. 66: 1006S-1010S.
Awai et al., (2006) "A phosphatidic acid-binding protein of the chloroplast inner envelope membrane involved in lipid trafficking" PNAS 103(28):10817-22.
Bao and Ohlrogge, (1999) "Supply of Fatty Acid is One Limiting Factor in the Accumulation of Triacylglycerol in Developing Embryos." Plant Physiology, 120:1057-1062.
Bäumlein, H., et al., (1991) "A Novel Seed Protein Gene From *Vicia faba* Is Developmentally Regulated in Transgenic Tobacco and *Arabidopsis* Plants," Molecular and General Genetics, 225(3): 459-467.
Benning, (2008) "A role for lipid trafficking in chloroplast biogenesis" Progress in Lipid Research 47, 381-389.
Benning, (2009) "Mechanisms of Lipid Transport Involved in Organelle Biogenesis in Plant Cells" Annu. Rev. Cell Dev. Biol. 25:71-91.
Bligh and Dyer, (1959) "Orange-red Flesh in Cod and Haddock" J. Fish. Res. Bd. Canada, 16(4):449-452.
Boggs et al. (1964) "Relation of Hexanal in Vapor Above Stored Potato Granules to Subjective Flavor Extimates." J. Food Sci. 29:487-489.
Bonanome and Grundy (1988) "Effect of Dietary Stearic Acid on Plasma Cholesterol and Lipoprotein Levels" N. Engl. Med. 318:1244-1248.
Brandt et al., (1985) "Primary Structure of a B1 Hordein Gene from Barley" Carlsberg Res. Commun., 50:333-345.
Broun et al. (1998) "A bifunctional oleate 12-hydroxylase: desaturase from *Lesquerella fenleri*." The Pant Journal, 13(2):201-210.
Buhr et al. (2002) "Ribozyme termination of RNA transcripts downregulate seed fatty acid genes in transgenic soybean" Plant J. 30: 155-163.
Cao et al., (2003) "Properties of the Mouse Intestinal Acyl-CoA:Monoacylglycerol Acyltransferase, MGAT2." The Journal of Biological Chemistry, 278(28)25657-25669.
Cernac (2004) "*WRINKLED1* encodes an AP2/EREB domain protein involved in the control of storage compound biosynthesis in *Arabidopsis*" The Plant Journal 40, 575-585.
Champagne et al. (1995) "Stabilization of Brown Rice Products Using Ethanol Vapors as an Antioxidant Delivery System" Cereal Chem 72:255-258.
Chang et al., (1978) "Chemical Reactions Involved in the Deep-Fat Frying of Foods." Journal of American Oil Chemists' Society, 55:718-727.
Chapman et al. (2001) "Transgenic Cotton Plants with Increased Seed Oleic Acid Content" Journal of American Chemists' Chemistry; vol. 78 No. 9, 941-947.
Cheng et al., (2003) "Identification of Acyl Coenzyme A:Monoacylglycerol Acyltransferase 3, an Intestinal Specific Enzyme Implicated in Dietary Fat Absorption." The Journal of Biological Chemistry, 278(126):13611-13614.
Cherry, (1983) "Cottonseed Oil" J. Am. Oil Chem. Soc. 60: 360-367.
Choudhury et al. (1980) "Lipids in Developing and Mature Rice Grain" Phytochemistry 19: 1063-1069.

Cicero et al. (2001) "Rice bran oil and [gamma]-oryzanol in the treatment of hyperlipoproteinaemias and other conditions" Phytotherapy Research; vol. 15 No. 4, 277-289.
Clapp et al., (1993) "The 16-Kilodalton N-Terminal Fragment of Human Prolactin is a Potent Inhibitor of Angiogenesis" Endocrinology, 133(3):1292-1299.
Colot et al., (1987) "Localization of sequences in wheat endosperm protein genes which confer tissue-specific expression in tobacco" The EMBO Journal, 6(12):3559-3564.
Comai et al., (2004) "Efficient discovery of DNA polymorphisms in natural populations by Ecotilling" The Plant Journal, 37:778-786.
Domergue et al., (2005) "In vivo characterization of the first acyl-CoA Δ6-desaturase from a member of the plant kingdom, the microalga *Ostreococcus tauri*." Biochem J. 389, 483-490.
Dougherty et al. (1995). Effects of diets containing high or low amounts of stearic acid on plasma lipoprotein fractions and fecal fatty acid excretion of men. Am. J. Clin. Nutr. 61:1120-1128.
Dowd et al., (2004) "Gene Expression Profile Changes in Cotton Root and Hypocotyl Tissues in Response to Infection with *Fusarium oxysporum* f. sp. vasinfectum" Molecular Plant-Microbe Interactions. 17: 654-667.
Dubois et al. (2007) "Fatty acid profiles of 80 vegetable oils with regard to their nutritional potential" European Journal of Lipid Science Technology 109(7):710-732.
Eastmond, (2006) "Sugar-Dependent1 Encodes a Patatin Domain Triacylglycerol Lipase That Initiates Storage Oil Breakdown in Germinating *Arabidopsis* Seeds" The Plant Cell, vol. 18, 665-675.
Folch et al., (1957) "A Simple Method for the Isolation and Purification of total Lipides From Animal Tissues" J. Biol. Chem. 226: 497.
Fuller et al., (1966) "A Gas Chromatographic Method for Continuous Accelerated Study of $O_2$ Uptake in Fats" JAOCS. 43:477-478.
Goffman et al., (2003) "Genetic Diversity for Lipid Content and Fatty Acid Profile in Rice Bran," Journal of the American Oil Chemists' Society 80:485-490.
Ha (2005) "Bioactive components in rice bran oil improve lipid profiles in rats fed on high-cholesterol diet" Nutrition research 25, 597-606.
Haseloff, J. and Gerlach, W.L., (1988) "Simple RNA Enzymes With New and Highly Specific Endoribonuclease Activities," Nature, 334: 585-591.
Henikoff et al., (2004) "TILLING. Traditional Mutagenesis Meets Functional Genomics." Plant Physiology, 2004, 135:630-636.
Hu et al. (1997) "Dietary Fat Intake and the Rist of Coronary Heart Disease in Women." N. Engl. J. Med. 337: 1491-1499.
Hutchins et al., (1968) "A New Process for the Selective Hydrogenation Cyclopropenoids in Cottonseed Oil" Journal of American Oil Chemists Society 45: 397-399.
Jennings and Akoh (2000) "Lipase-Catalyzed Modification of Rice Bran Oil to Incorporate Capric Acid." Journal of Agricultural and Food Chemistry, 48:4439-4443.
Jones et al. (1995) "Palmitoyl-Acyl Carrier Protein (ACP) Thioesterase and the Evolutionary Origin of Plant Acyl-ACP Thioesterases." Plant Cell 7: 359-371.
Kargiotidou et al., (2008) "Low temperature and light regulate delta 12 fatty acid desaturases (FAD2) at a transcriptional level in cotton (*Gossypium hirsutum*)" Journal of Experimental Botany 2008 59(8): 2043-2056.
Kelly et al., (2012) "Suppression of the *Sugar-Dependent1* triacylglycerol lipase family during seed development enhances oil yield in oilseed rape (*Brassica napus* L.)" Plant Biotechnology Journal, pp. 1-7.
Kelly et al., (2011) "Seed Storage Oil Mobilization Is Important But Not Essential for Germination or Seedling Establishment in *Arabidopsis*" Plant Physiology, vol. 157, pp. 866-875.
Kinney (1996) "Development of Genetically Engineered Soybean Oils for Food Applications." J. Food Lipids 3: 273-292.
Klahre et al. (2002) "High molecular weight RNAs and small interfering RNAs induce systemic posttranscriptional gene silencing in plants." PNAS 99(18): 11981-11986.
Kodama et al. (1997) "Structure, chromosomal location and expression of a rice gene encoding the microsome ω-3 fatty acid desaturase." Plant Molecular Biology 33:493-502.

(56) References Cited

OTHER PUBLICATIONS

Kohno-Murase et al. (2006) "Production of trans-10, cis-12 conjugated linoleic acid in rice." Transgenic Research 15:95-100.
Kozeil et al. (1996) "Optimizing expression of transgenes with an emphasis on post-transcriptional events." Plant Molecular Biology, 32:393-405.
Langridge et al., Trends in genetic and genome analysis in wheat: a review. Aust. J. Agric. Res., 2001, 52:1043-1077.
Lee, M., et al., (1998) "Identification of Non-Heme Diiron Proteins That Catalyze Triple Bond and Epoxy Group Formation," Science, 280(5365): 915-918.
Lemieux B., (2000) "High Throughput Single Nucleotide Polymorphism Genotyping Technology." Current Genomics, 2000, 1:301-311.
Leonard et al. (1997) "*Cuphea wrightii* thioesterases have unexpected broad specificities on saturated fatty acids." Plant Molecular Biology, vol. 34, Issue 4: 669-679.
Li et al., (1997) "Comparison of promoters and selectable marker genes for use in Indica rice transformation." Molecular Breeding, 3:1-14.
Liu et al., (2002) "High-Stearic and High-Oleic Cottonseed Oils Produced by Hairpin RNA-Mediated Post-Transcriptional Gene Silencing." Plant Physiology, 129(4):1732-1743.
Liu et al. (1999) "Molecular cloning and expression of a cDNA encoding a microsomal ω-6 fatty acid desaturase from cotton (*Gossypium hirsutum*)" Aust. J. Plant Physiol. 26:101-106.
Liu et al. (1997) EMBL Nucleotide Sequence Database as X97016.
Liu et al., (2000) "Genetic modification of cotton seed oil using inverted-repeat gene-silencing techniques." Biochemical Society Transations, 28(6):927-929.
Liu et al. (2002) "High-Oleic and High-Stearic Cottonseed Oils: Nutritionally Improved Cooking Oils Developed Using Gene Silencing." J. Am. Coll. Nutr. 21: 205S-211S.
Liu et al., (1999) "Cloning and Sequence Analysis of a Novel Member (Accession No. Y10112) of the Microsomal ω-6 Fatty Acid Desaturase Family from Cotton" Plant Physiol. (PGR 99-063) 120: 339.
Lu et al., (2011) "New frontiers in oilseed biotechnology: meeting the global demand for vegetable oils for food, feed, biofuel, and industrial applications" Current Opinion in Biotechnology, 22:252-259.
Lu et al. (1993) "High efficiency retroviral mediated gene transduction into single isolated immature and replatable CD343+ hematopoietic stem/progenitor cells from human umbilical cord blood." J. Exp. Med., 178, 2089-2096.
Mensink and Katan (1990) "Effect of Dietary Trans Fatty Acids on High-Density and Low-Density Lipoprotein Cholesterol Levels in Healthy Subjects." N. Engl. J. Med. 323: 439-445.
Mikkilineni and Rocheford (2003) "Sequence variation and genomic organization of fatty acid desaturase-2 (fad2) and fatty acid desaturase-6 (fad6) cDNAs in maize." Theor. Applied Genetics, 106, 1326-1332.
Millar and Waterhouse (2005) "Plant and animal microRNAs: similarities and differences." Funct Integr Genomics, 2005, 5:129-135.
Miquel et al. (1992) "*Arabidopsis* mutants deficient in polyunsaturated fatty acid synthesis: Biochemical and genetic characterization of a plant oleoyl-phosphatidylcholine desaturase" Journal of Biological Chemistry; vol. 267 No. 3, 1502-1509.
Moghadasian and Frohlich (1999) "Effects of Dietary Phytosterols on Cholesterol Metabolism and Atherosclerosis: Clinical and Experimental Evidence." Am. J. Med. 107: 588-94.
Mojovic et al., (1993) "*Rhizopus arrhizus* lipase-catalyzed interesterification of the midfraction of palm oil to a cocoa butter equivalent fat" Enzyme Microb Technol. 15: 438-443.
Morrison (1988) "Lipids in Cereal Starches: A Review." J Cereal Sci. 8:1-15.
Most et al. (2005) "Rice bran oil, not fiber, lowers cholesterol in humans." Am J Clin Nutr 81:64-8.
Mounts et al. (1998) "Effect of Altered Fatty Acid Composition on Soybean Oil Stability" J Am. Oil Chem. Soc. 65:624-628.

Needleman & Wunsch (1970) "A general method applicable to the search for similarities in the amino acid sequence of two proteins." J. Mol. Biol., 48, 443-453.
Nielsen et al. (2004) Formation of Volatile Compounds in Model Experiments with Crude Leek (*Allium ampeloprasum* Var. Lancelot) Enzyme Extract and Linoleic Acid or Linolenic Acid. Journal of Agricultural and Food Chemistry 52:2315-2321.
Noakes and Clifton (1998) "Oil blends containing partially hydrogenated or interesterified fats: differential effects on plasma lipids." Am. J. Clin. Nutr. 98: 242-247.
O'Brien, (2002) Cottonseed Oil. In: F.D. Gunstone (Ed.) Vegetable Oils in Food Technology: Composition, Properties and Uses. Blackwell Publishing, Oxford, pp. 203-230.
O'Brien (2005) "Cottonseed Oil" Bailey's Industrial Oil and Fat Products, 6th Edition, edited by Fereidoon Shahidi.
Okuley et al. (1994) "*Arabidopsis* FAD2 Gene Encodes the Enzyme that is Essential for Polyunsaturated Lipid Synthesis." Plant Cell, 6:147-158.
Ohlrogge and Jaworski (1997) "Regulation of Fatty Acid Synthesis. Annu Rev Plant Physiol Plant Mol Biol." 48:109-136.
Perriman, R., et al., (1992) "Extended Target-Site Specificity for a Hammerhead Ribozyme," Gene, 113(2): 157-163.
Petrie et al., (2012) "Recruiting a New Substrate for Triacylglycerol Synthesis in Plants: The Monoacylglycerol Acyltransferase Pathway" PLoS ONE 7(4): e35214, pp. 1-8.
Pirtle et al. (1999) "Characterization of a Palmitoyl-Acyl Carrier Protein Thioesterase (FatB1) in Cotton" Plant Cell Physiology 40:2 p. 155-163.
Pirtle et al., (2001) "Molecular cloning and functional expression of the gene for a cotton v-12 fatty acid desaturase (FAD2)" Biochim. Biophys. Acta 1522: 122-129.
Radcliffe et al. (1997) "Serum Lipids in Rats Fed Diets Containing Rice Bran Oil or High-Linolenic Acid Safflower Oil." Biochemical Archives 13:87-95.
Resurreccion et al. (1979) "Nutrient Content and Distribution in Milling Fractions of Rice Grain." Journal of the Science of Food and Agriculture, 30: 475-481.
Roche and Gibney (2000) "Effect of long-chain n-3 polyunsaturated fatty acids on fasting and postprandial triacylglycerol metabolism." Am. J. Clin. Nutr. 71: 232S-237S.
Roston et al., (2012) "TGD1, -2, and -3 Proteins Involved in Lipid Trafficking Form ATP-binding Cassette (ABC) Transporter with Multiple Substrate-binding Proteins" The Journal of Biological Chemistry vol. 287, No. 25, pp. 21406-21415.
Rukmini and Raghuram (1991) "Nutritional and Biochemical Aspects of the Hypolipidemic Action of Rice Bran Oil: A Review." Journal of the American College of Nutrition 10(6):593-601.
Sanjaya et al., (2011) "Increasing the energy density of vegetative tissues by diverting carbon from starch to oil biosynthesis in transgenic *Arabidapsis*" Plant Biotechnology Journal 9, pp. 874-883.
Senior I.J., (1998) "Uses of Plant Gene Silencing." Biotechnology & Genetic Engineering Reviews, Ed. Tombs, M.P., 15:79-119.
Shenstone and Vickery, (1961) "Occurrence of Cyclo-Propene Acids in Some Plants of the Order Malvales" Nature 190: 68-169.
Shin et al. (1986) "Correlation Between Oxidative Deterioration of Unsaturated Lipid and n-Hexanal during Storage of Brown Rice." J. Food Sci. 51:460-463.
Shippy, R., et al., (1999) "The Hairpin Ribozyme—Discovery, Mechanism, and Development for Gene Therapy," Molecular Biotechnology, 12(1): 117-129.
Sivaraman et al. (2004) "Development of high oleic and low linoleic acid transgenics in a zero erucic acid *Brassica juncea* L. (Indian mustard) line by antisense suppression of the fad2 gene" Molecular Breeding, Kluwer Academic Publishers, DO; vol. 13 No. 1, 365-375.
Slade and Knauf, (2005) "TILLING moves beyond functional genomics into crop improvement." Transgenic Research, 14:109-115.
Smith et al. (2000) "Total silencing by intron-spliced hairpon RNAs" Nature 407:319-320.
Stalberg et al., (1993) "Deletion Analysis of a 2S Seed Storage Protein Promoter of *Brassica napus* in Transgenic Tobacco," Plant Molecular Biology, 23 (4): 671-683.

(56) References Cited

OTHER PUBLICATIONS

St Angelo et al. (1980) "Identification of Lipoxygenase-Linoleate Decomposition Products by Direct Gas Chromatography-Mass Spectrometry." J Lipids 1:45-49.
Stoutjesdijk et al. (2002) "hpRNA-mediated targeting of the *Arabidopsis* FAD2 gene gives highly efficient and stable silencing" Plant Physiology, American Society of Plant Physiologists, Rockville, MD, US; vol. 129, 1723-31.
Stoutjesdijk et al., (2000) "High-oleic acid Australian *Brassica napus* and *B. juncea* varieties produced by co-suppression of endogenous Δ12-desaturases." Biochem. Soc. Trans. 28: 938-940.
Suzuki et al. (1999) "Volatile Components in Stored Rice [*Oryza sativa* (L.)] of Varieties with and without Lipoxygenase-3 in Seeds." J. Agric. Food Chem. 47: 1119-1124.
Taira et al. (1989) "Fatty Acid Composition of Indica-Types and Japonica-Types of Rice Bran and Milled Rice" Journal of the American Oil Chemists' Society; vol. 66 No. 9, 1326-1329.
Taira et al. (1988) "Fatty Acid Composition of Indica Sinica Javanica and Japonica Groups of Nonglutinous Brown Rice" Journal of Agricultural and Food Chemistry; vol. 36 No. 1, 45-47.
Taira et al. (1986) "Lipid Content and Fatty-Acid Composition of Indica and Japonica Types of Nonglutinous Brown Rice" Journal of Agriculture and Food Chemistry; vol. 34 No. 3, 542-545.
Taira and Chang (1986) "Lipid content and fatty acid composition of Indica and Japonica types of nonglutinous brown rice." Agric. Food Chem. 34:542-545.
Thelen and Ohlrogge (2002) "Metabolic Engineering of Fatty Acid Biosynthesis in Plants." Metabolic Engineering 4: 12-21.
Theriault et al. (1999). "Tocotrienol: A Review of its Therapeutic Potential." Clin. Biochem. 32: 309-19.
Tholstrup et al. (1994) "Fat high in stearic acid favorably affects blood lipids and factor VII coagulant activity in comparison with fats high in palmitic acid or high in myristic and lauric acids." Am. J. Clin. Nutr. 59: 371-377.
To et al., (2012) "WRINKLED Transcription Factors Orchestrate Tissue-Specific Regulation of Fatty Acid Biosynthesis in *Arabidopsis*" The Plant Cell, vol. 24: 5007-5023.
Toriyama et al., "Haploid and diploid plant regeneration from protoplasts of anther callus in rice." Theor Appl Genet, 1986, 73:16-19.
Tsugita et al (1983) "Cooking Flavor and Texture of Rice Stored under Different Conditions." Agricultural and Biological Chemistry 47: 543-549.
Tsuzuki et al (2004) "Oxidation Rate of Conjugated Linoleic Acid and Conjugated Linolenic Acid is Slowed by Triacylglycerol Esterification and α-Tocopherol." Lipids 39:475-480.
Trautwein, E.A., (2001) "n-3 Fatty Acids—Physiological and Technical Aspects for Their Use in Food," European Journal of Lipid Science and Technology, 103(1): 45-55.
Valvekens, D., et al., (1988) "*Agrobacterium tumefaciens*-Mediated Transformation of *Arabidopsis thaliana* Root Explants by Using Kanamycin Selection," Proceedings of the National Academy of Sciences of the United States of America, 85(15) 5536-5540.
van de Loo, F. J., Broun, P., Turner, S., & Somerville, C. (1995) "An oleate 12-hydroxylase from *Ricinus communis* L. is a fatty acyl desaturase homolog." Proc. Natl. Acad. Sci. USA, 92, 6743-6747.
Vanhercke et al. (2013) "Synergistic effect of WRI1 and DGAT1 coexpression on triacylglycerol biosynthesis in plants" FEBS Letters 587:364-369.
Voelker et al. (1996) "Genetic engineering of a quantitative trait: metabolic and genetic parameters influencing the accumulation of laurate in rapeseed." Plant J. 9: 229-241.
Wagner et al. (1992) "Coupling of adenovirus to transferrin-polylysine/DNA complexes greatly enhances receptor-mediated gene delivery and expression of transfected genes." Proc. Natl. Acad. Sci. USA, 89, 6099-6103.
Wang et al. (1998) "Improved Vectors for *Agrobacterium tumefaciens*-Mediated Transformation of Monocot Plants." Acta Hort, 1998, 461:401-407.

Waterhouse, P.M., et al., (1998) "Virus Resistance and Gene Silencing in Plants Can Be Induced by Simultaneous Expression of Sense and Antisense RNA," Proceedings of the National Academy of Sciences of the United States of America, 95(23): 13959-13964.
Williams et al. (1999) "Impaired Endothelial Function Following a Meal Rich in Used Cooking Fat." J. Am. Coll. Cardiol. 33:1050-1055.
Whitelaw et al. (1986) "A Rice FATB Insertional Mutant Exhibits Improved Growth and Reduced Photoinhibition at High Temperatures" Proceedings of the 55th Australian Cereal Chemistry Conference, 55th Australian Cereal Chemistry Conference, Jul. 3-7, 2008, Sydney Australia, Jul. 3, 2005, pates 101-104.
Whitelaw et al., (2004) "Investigation of lipid synthesis in the rice grain: modification of fatty acids in rice bran oil." In C.K. Black, J.F. Panozzo, and G.J. Rebetzke (Eds.), Cereals 2004: Proceedings of the 54th Australian Cereal Chemistry Conference and 11th Wheat Breeders Assembly, 21st-245th Sep. 2004, Canberra ACT, North Melbourne VIC: Cereal Chemistry Division, Royal Australian Chemical Institute, AU (pp. 418-420).
Xu et al., (2008) "Cloning and characterization of an acyl-CoA-dependent *diacylglycerol acyltransferase* 1 (DGAT1) gene from *Tropaeolum majus*, and a study of the functional motifs of the DGAT protein using site-directed mutagenesis to modify enzyme activity and oil content" Plant Biotechnology Journal 6, pp. 799-818.
Xu et al., (2008) "Lipid Trafficking between the Endoplasmic Reticulum and the Plastid in *Arabidopsis* Requires the Extraplastidic TGD4 Protein" The Plant Cell, vol. 20: 2190-2204.
Xu et al., (2005) "Mutation of the TGD1 Chloroplast Envelope Protein Affects Phosphatidate Metabolism in *Arabidopsis*" The Plant Cell, vol. 17, 3094-3110.
Xu et al., (2010) "Lipid Transport Mediated by *Arabidopsis* TGD Proteins is Unidirectional from the Endoplasmic Reticulum to the Plastid" Plant Cell Physiol, 51(6): 1019-1028.
Yasumatsu et al. (1966) "Studies on Cereals Part V Stale Flavor of Stored Rice." Agric. Biol. Chem. 30:483-486.
Zhou et al. (2002) "Ageing of Stored Rice: Changes in Chemical and Physical Attributes." Journal of Cereal Science 35:65-78.
Zock et al. (1994) "Impact of myristic acid versus palmitic acid on serum lipid and piloprotein levels in healthy women and men." Arterioscler Thromb. 14: 567-575.
Liu et al., (2005) GenBank Accession No. AY574036.
Liu et al., (2005) GenBank Accession No. AY574037.
Liu et al., (2005) GenBank Accession No. AY574038.
Connolly et al. (1998) GenBank Accession No. AC004236, NCBI, pp. 1-11.
Sharma et al., (2003) GenBank Accesion No. AC108870, NCBI, pp. 1-27.
Kim et al., (1999) GenBank Accesion No. AF213480, NCBI, p. 1.
Sasaki et al., (2001) GenBank Accession No. AP004047, NCBI, pp. 1-36.
Sasaki et al., (1999) GenBank Accession No. AP000399, NCBI, pp. 1-33.
Sasaki et al., (2001) Genbank Accession No. AP004236, NCBI, pp. 1-37.
Sasaki et al., (2002) GenBank Accession No. AP005168, NCBI, pp. 1-31.
Sasaki et al., (2002) GenBank Accession No. AP005291, NCBI, pp. 1-38.
File History of U.S. Patent Publication No. 2011-0314725, Petrie et al., published Dec. 29, 2011 (U.S. Appl. No. 13/171,032, filed Jun. 28, 2011).
File History of U.S. Patent Publication No. 2011-0223311, Liu et al., published Sep. 15, 2011 (U.S. Appl. No. 13/011,773, filed Jan. 21, 2011).
File History for U.S. Patent Publication No. 2009-0308041, Whitelaw et al., Dec. 17, 2009 (U.S. Appl. No. 12/309,276, filed Jul. 6, 2009).
File History of U.S. Patent Publication No. 2011-0229623, Liu et al., Sep. 22, 2011 (U.S. Appl. No. 13/011,779, filed Jan. 21, 2011).
File history of U.S. Patent Application Publication No. 2011/0314725, Petrie et al., published Dec. 29, 2011 (U.S. Appl. No. 13/171,032, filed Jun. 28, 2011).

(56) References Cited

OTHER PUBLICATIONS

Jul. 30, 2013 Office Action, issued in connection with U.S. Appl. No. 13/841,641.

Vanhercke et al (2013) "Synergistic effect of WRI1 and DGAT1 coexpression on triacylglycerol biosynthesis in plants" FEBS Letters 587, 364-369.

Sheikh et al (2002) "Fatty Acids Composition in Germinating Cotton Seedlings Affected by High Temperature Stress" Pakistan Journal of Applied Sciences 2:1 p. 97-99.

James et al (2010) "Disruption of the *Arabidopsis* CGI-58 homologue produces Chanarin-Dorfman-like lipid droplet accumulation in plants," 107(41):17833-17838 and supporting information pp. 1-3.

Sanjaya et al (2013) "Altered Lipid Composition and Enhanced Nutritional Value of *Arabidopsis* Leaves following Introduction of an Algal Diacylglycerol Acyltransferase 2" Plant Cell, 1-17.

Slocombe et al (2009) "Oil accumulation in leaves directed by modification of fatty acid breakdown and lipid synthesis pathways" Plant Biotechnology Journal, 7, 694-703.

Yang & Ohlrogge "Turnover of Fatty Acids during Natural Senescence of *Arabidopsis, Brachypodium*, and Switchgrass and in *Arabidopsis* b-Oxidation Mutants" Plant Physiology, 150, 1981-1989.

Takeyama, H., et al., (1997) "Expression of the Eicosapentaenoic Acid Synthesis Gene Cluster From *Shewanella* sp. In a Transgenic Marine *Cyanobacterium, Synechococcus* sp.," Microbiology, 143(Pt 8): 2725-2731.

U.S. Appl. No. 13/841,641, filed Mar. 15, 2013 (Vanhercke et al.).

GenBank Accession No. BAC45173.1, Sasaki et al. (2002).

GenBank Accession No. BAC45170.1, Sasaki et al. (2002).

International Search Report and Written Opinion of the International Searching Authority issued Apr. 8, 2013 in connection with PCT International Patent Application No. PCT/AU2012/001598, which claims priority of U.S. Appl. No. 61/718,563, filed Oct. 25, 2012 and U.S. Appl. No. 61/580,590, filed Dec. 27, 2011.

Rajasekharan et al., (2006) "Monoacylglycerol as an intermediate in triacylglycerol biosynthesis in plants" International Symposium on Plant Lipids, Abstract.

Vanhercke et al (2013) "Metabolic engineering of biomass for high energy density: oilseed-like triacylglycerol yields from plant leaves" Plant Biotechnol. J., doi: 10.1111/pbi.12131 (pp. 1-9).

Yang & Ohlrogge (2009) "Turnover of Fatty Acids during Natural Senescence of *Arabidopsis, Brachypodium*, and Switchgrass and in *Arabidopsis* b-Oxidation Mutants" Plant Physiology, 150, 1981-1989.

Oct. 30, 2013 Response filed in connection with U.S. Appl. No. 13/841,641.

File History of U.S. Patent Application Publication No. 2013/0164798, Vanhercke et al., published Jun. 27, 2013 (U.S. Appl. No. 13/841,641, filed Mar. 15, 2013).

\* cited by examiner

Soybean synergy insert

9734bp

12ABFJYC pJP3569 insert

10374pb

PROCESSES FOR PRODUCING HYDROCARBON PRODUCTS

CROSS-REFERENCE TO RELATED APPLICATIONS

This application claims benefit of U.S. Provisional Patent Application No. 61/718,563, filed Oct. 25, 2012, and U.S. Provisional Patent Application No. 61/580,590, filed Dec. 27, 2011, the entire contents of each of which are hereby incorporated by reference into the subject application.

REFERENCE TO A SEQUENCE LISTING

This application incorporates-by-reference nucleotide and/or amino acid sequences which are present in the file named "121221_2251_83668-A_Sequence_Listing_REB.txt," which is 1.22 megabytes in size, and which was created Dec. 21, 2012 in the IBM-PC machine format, having an operating system compatibility with MS-Windows, which is contained in the text file filed Dec. 21, 2012 as part of this application.

FIELD OF THE INVENTION

The present invention relates to methods of producing industrial products such as hydrocarbon products from lipids produced in plants, particularly in vegetative parts of plants, and in algae and other non-human organisms. In particular, the present invention provides plants having an increased level of one or more non-polar lipids such as triacylglycerols and an increased total non-polar lipid content. In one particular embodiment, the present invention relates to any combination of lipid handling enzymes, oil body proteins and/or transcription factors regulating lipid biosynthesis to increase the level of one or more non-polar lipids and/or the total non-polar lipid content and/or mono-unsaturated fatty acid content in plants or any part thereof including plant seed and/or leaves, algae and fungi. In an embodiment, the conversion of the lipid to the hydrocarbon products occurs in harvested plant vegetative parts to produce alkyl esters of the fatty acids which are suitable for use as a renewable biodiesel fuel.

BACKGROUND OF INVENTION

The majority of the world's energy, particularly for transportation, is supplied by petroleum derived fuels, which have a finite supply. Alternative sources which are renewable are needed, such as from biologically produced oils.
Triacylglycerol Biosynthesis Triaclyglycerols (TAG) constitute the major form of lipids in seeds and consist of three acyl chains esterified to a glycerol backbone. The fatty acids are synthesized in the plastid as acyl-acyl carrier protein (ACP) intermediates where they can undergo a first desaturation catalyzed. This reaction is catalyzed by the stearoyl-ACP desaturase and yields oleic acid (C18:1$^{\Delta 9}$). Subsequently, the acyl chains are transported to the cytosol and endoplasmic reticulum (ER) as acyl-Coenzyme (CoA) esters. Prior to entering the major TAG biosynthesis pathway, also known as the Kennedy or glycerol-3-phosphate (G3P) pathway, the acyl chains are typically integrated into phospholipids of the ER membrane where they can undergo further desaturation. Two key enzymes in the production of polyunsaturated fatty acids are the membrane-bound FAD2 and FAD3 desaturases which produce linoleic (C18:2$^{\Delta 9,12}$) and α-linolenic acid (C18:3$^{\Delta 9,12,15}$) respectively.

TAG biosynthesis via the Kennedy pathway consists of a series of subsequent acylations, each using acyl-CoA esters as the acyl-donor. The first acylation step typically occurs at the sn1-position of the G3P backbone and is catalyzed by the glycerol-3-phosphate acyltransferase (sn1-GPAT). The product, sn1-lysophosphatidic acid (sn1-LPA) serves as a substrate for the lysophosphatidic acid acyltransferase (LPAAT) which couples a second acyl chain at the sn2-position to form phosphatidic acid. PA is further dephosphorylated to diacylglycerol (DAG) by the phosphatidic acid phosphatase (PAP) thereby providing the substrate for the final acylation step. Finally, a third acyl chain is esterified to the sn3-position of DAG in a reaction catalyzed by the diacylglycerol acyltransferase (DGAT) to form TAG which accumulates in oil bodies. A second enzymatic reaction, phosphatidyl glycerol acyltransferase (PDAT), also results in the conversion of DAG to TAG. This reaction is unrelated to DGAT and uses phospholipids as the acyl-donors.

To maximise yields for the commercial production of lipids, there is a need for further means to increase the levels of lipids, particularly non-polar lipids such as DAGs and TAGs, in transgenic organisms or parts thereof such as plants, seeds, leaves, algae and fungi. Attempts at increasing neutral lipid yields in plants have mainly focused on individual critical enzymatic steps involved in fatty acid biosynthesis or TAG assembly. These strategies, however, have resulted in modest increases in seed or leaf oil content. Recent metabolic engineering work in the oleaginous yeast *Yarrowia lipolytica* has demonstrated that a combined approach of increasing glycerol-3-phosphate production and preventing TAG breakdown via β-oxidation resulted in cumulative increases in the total lipid content (Dulermo et al., 2011).

Plant lipids such as seedoil triaclyglycerols (TAGs) have many uses, for example, culinary uses (shortening, texture, flavor), industrial uses (in soaps, candles, perfumes, cosmetics, suitable as drying agents, insulators, lubricants) and provide nutritional value. There is also growing interest in using plant lipids for the production of biofuel.

To maximise yields for the commercial biological production of lipids, there is a need for further means to increase the levels of lipids, particularly non-polar lipids such as DAGs and TAGs, in transgenic organisms or parts thereof such as plants, seeds, leaves, algae and fungi.

SUMMARY OF THE INVENTION

The present inventors have demonstrated significant increases in the lipid content of organisms, particularly in the vegetative parts and seed of plants, by manipulation of both fatty acid biosynthesis and lipid assembly pathways. Various combinations of genes were used to achieve substantial increases in oil content, which is of great significance for production of biofuels and other industrial products derived from oil.

In a first aspect, the invention provides a process for producing an industrial product from a vegetative plant part or non-human organism or part thereof comprising high levels of non-polar lipid.

In an embodiment, the present invention provides a process for producing an industrial product, the process comprising the steps of:
i) obtaining a vegetative plant part having a total non-polar lipid content of at least 10% (w/w dry weight), ii) either
  a) converting at least some of the lipid in the vegetative plant part of step i) to the industrial product by applying heat, chemical, or enzymatic means, or any combination thereof, to the lipid in situ in the vegetative plant part, or
  b) physically processing the vegetative plant part of step i), and subsequently or simultaneously converting at least some of the lipid in the processed vegetative plant part to the industrial product by applying heat, chemical, or enzymatic means, or any combination thereof, to the lipid in the processed vegetative plant part, and
iii) recovering the industrial product,
thereby producing the industrial product.

In another embodiment, the invention provides a process for producing an industrial product, the process comprising the steps of:
  i) obtaining a vegetative plant part having a total non-polar lipid content of at least about 3%, preferably at least about 5% or at least about 7% (w/w dry weight),
  ii) converting at least some of the lipid in situ in the vegetative plant part to the industrial product by heat, chemical, or enzymatic means, or any combination thereof, and
  iii) recovering the industrial product, thereby producing the industrial product.

In another embodiment, the process for producing an industrial product comprises the steps of:
  i) obtaining a vegetative plant part having a total non-polar lipid content of at least about 3%, preferably at least about 5% or at least about 7% (w/w dry weight),
  ii) physically processing the vegetative plant part of step i),
  iii) converting at least some of the lipid in the processed vegetative plant part to the industrial product by applying heat, chemical, or enzymatic means, or any combination thereof, to the lipid in the processed vegetative plant part, and
  iv) recovering the industrial product,
thereby producing the industrial product.

In another embodiment, the process for producing an industrial product comprises the steps of:
  i) obtaining a non-human organism or a part thereof comprising one or more exogenous polynucleotide(s), wherein each of the one or more exogenous polynucleotide(s) is operably linked to a promoter which is capable of directing expression of the polynucleotide in a non-human organism or a part thereof, and wherein the non-human organism or part thereof has an increased level of one or more non-polar lipids relative to a corresponding non-human organism or a part thereof lacking the one or more exogenous polynucleotide(s), and
  ii) converting at least some of the lipid in situ in the non-human organism or part thereof to the industrial product by heat, chemical, or enzymatic means, or any combination thereof, and
  iii) recovering the industrial product,
thereby producing the industrial product.

In a further embodiment, the process for producing an industrial product comprises the steps of:
  i) obtaining a non-human organism or a part thereof comprising one or more exogenous polynucleotides, wherein the non-human organism or part thereof has an increased level of one or more non-polar lipids relative to a corresponding non-human organism or a part thereof lacking the one or more exogenous polynucleotides,
  ii) physically processing the non-human organism or part thereof of step i),
  iii) converting at least some of the lipid in the processed non-human organism or part thereof to the industrial product by applying heat, chemical, or enzymatic means, or any combination thereof, to the lipid in the processed non-human organism or part thereof, and
  iv) recovering the industrial product,
thereby producing the industrial product.

In each of the above embodiments, it would be understood by a person skilled in the art that the converting step could be done simultaneously with or subsequent to the physical processing step.

In each of the above embodiments, the total non-polar lipid content of the vegetative plant part, or non-human organism or part thereof, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight). In a further preferred embodiment, the total non-polar lipid content is between 5% and 25%, between 7% and 25%, between 10% and 25%, between 12% and 25%, between 15% and 25%, between 7% and 20%, between 10% and 20%, between 10% and 15%, between 15% and 20%, between 20% and 25%, about 10%, about 11%, about 12%, about 13%, about 14%, about 15%, about 16%, about 17%, about 18%, about 20%, or about 22%, each as a percentage of dry weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total TAG content of the vegetative plant part, or non-human organism or part thereof, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, or more preferably at least about 17% (w/w dry weight). In a further preferred embodiment, the total TAG content is between 5% and 30%, between 7% and 30%, between 10% and 30%, between 12% and 30%, between 15% and 30%, between 7% and 30%, between 10% and 30%, between 20% and 28%, between 18% and 25%, between 22% and 30%, about 10%, about 11%, about 12%, about 13%, about 14%, about 15%, about 16%, about 17%, about 18%, about 20%, or about 22%, each as a percentage of dry weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total lipid content of the vegetative plant part, or non-human organism or part thereof, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, more preferably at least about 17% (w/w dry weight), more preferably at least about 20%, more preferably at least about 25%. In a further preferred embodiment, the total lipid content is between 5% and 35%, between 7% and 35%, between 10% and 35%, between 12% and 35%, between 15% and 35%, between 7% and 35%, between 10% and 20%, between 18% and 28%, between 20% and 28%, between 22% and 28%, about 10%, about 11%, about 12%, about 13%, about 14%, about 15%, about 16%, about 17%, about 18%, about 20%, about 22%, or about 25%, each as a percentage of dry weight. Typically, the total lipid content of the vegetative plant part, or non-human organism or part thereof is about 2-3% higher than the non-polar lipid content. In a particularly preferred embodiment, the vegetative plant part is a leaf (or leaves) or a portion thereof. In a more preferred embodiment, the vegetative plant part is a leaf portion having a surface area of at least 1 cm$^2$.

The industrial product may be a hydrocarbon product such as fatty acid esters, preferably fatty acid methyl esters and/or a fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar. The industrial product may be a mixture of any of these components, such as a mixture of alkanes, or alkanes and alkenes, preferably a mixture which is predominantly (>50%) C4-C8 alkanes, or predominantly C6 to C10 alkanes, or predominantly C6 to C8 alkanes. The industrial product is not carbon dioxide and not water, although these molecules may be produced in combination with the industrial product. The industrial product may be a gas at atmospheric pressure/room temperature, or preferably, a liquid, or a solid such as biochar, or the process may produce a combination of a gas component, a liquid component and a solid component such as carbon monoxide, hydrogen gas, alkanes and biochar, which may subsequently be separated. In an embodiment, the hydrocarbon product is predominantly fatty acid methyl esters. In an alternative embodiment, the hydrocarbon product is a product other than fatty acid methyl esters.

The industrial product may be an intermediate product, for example, a product comprising fatty acids, which can subsequently be converted to, for example, biofuel by, for example, trans-esterification to fatty acid esters.

Heat may be applied in the process, such as by pyrolysis, combustion, gasification, or together with enzymatic digestion (including anaerobic digestion, composting, fermentation). Lower temperature gasification takes place at, for example, between about 700° C. to about 1000° C. Higher temperature gasification takes place at, for example, between about 1200° C. to about 1600° C. Lower temperature pyrolysis (slower pyrolysis), takes place at, for example, about 400° C., whereas higher temperature pyrolysis takes place at, for example, about 500° C. Mesophilic digestion takes place between, for example, about 20° C. and about 40° C. Thermophilic digestion takes place from, for example, about 50° C. to about 65° C.

Chemical means include, but are not limited to, catalytic cracking, anaerobic digestion, fermentation, composting and transesterification. In an embodiment, a chemical means uses a catalyst or mixture of catalysts, which may be applied together with heat. The process may use a homogeneous catalyst, a heterogeneous catalyst and/or an enzymatic catalyst. In an embodiment, the catalyst is a transition metal catalyst, a molecular sieve type catalyst, an activated alumina catalyst or sodium carbonate. Catalysts include acid catalysts such as sulphuric acid, or alkali catalysts such as potassium or sodium hydroxide or other hydroxides. The chemical means may comprise transesterification of fatty acids in the lipid, which process may use a homogeneous catalyst, a heterogeneous catalyst and/or an enzymatic catalyst. The conversion may comprise pyrolysis, which applies heat and may apply chemical means, and may use a transition metal catalyst, a molecular sieve type catalyst, an activated alumina catalyst and/or sodium carbonate.

Enzymatic means include, but are not limited to, digestion by microorganisms in, for example, anaerobic digestion, fermentation or composting, or by recombinant enzymatic proteins.

The lipid that is converted to an industrial product in this aspect of the invention may be some, or all, of the non-polar lipid in the vegetative plant part or non-human organism or part thereof, or preferably the conversion is of at least some of the non-polar lipid and at least some of the polar lipid, and more preferably essentially all of the lipid (both polar and non-polar) in the vegetative plant part or non-human organism or part thereof is converted to the industrial product(s).

In an embodiment, the conversion of the lipid to the industrial product occurs in situ without physical disruption of the vegetative plant part or non-human organism or part thereof. In this embodiment, the vegetative plant part or non-human organism or part thereof may first be dried, for example by the application of heat, or the vegetative plant part or non-human organism or part thereof may be used essentially as harvested, without drying. In an alternative embodiment, the process comprises a step of physically processing the vegetative plant part, or the non-human organism or part thereof. The physical processing may comprise one or more of rolling, pressing such as flaking, crushing or grinding the vegetative plant part, non human organism or part thereof, which may be combined with drying of the vegetative plant part, or the non-human organism or part thereof. For example, the vegetative plant part, or non-human organism or part thereof may first be substantially dried and then ground to a finer material, for ease of subsequent processing.

In an embodiment, the weight of the vegetative plant part, or the non-human organism or part thereof used in the process is at least 1 kg or preferably at least 1 tonne (dry weight) of pooled vegetative plant parts, or the non-human organisms or parts thereof. The processes may further comprise a first step of harvesting vegetative plant parts, for example from at least 100 or 1000 plants grown in a field, to provide a collection of at least 1000 such vegetative plant parts, i.e., which are essentially identical. Preferably, the vegetative plant parts are harvested at a time when the yield of non-polar lipids are at their highest. In one embodiment, the vegetative plant parts are harvested about at the time of flowering. In another embodiment, the vegetative plant parts are harvested from about at the time of flowering to about the beginning of senescence. In another embodiment, the vegetative plant parts are harvested when the plants are at least about 1 month of age.

The process may or may not further comprise extracting some of the non-polar lipid content of the vegetative plant part, or the non-human organism or part thereof prior to the conversion step. In an embodiment, the process further comprises steps of:

(a) extracting at least some of the non-polar lipid content of the vegetative plant part or the non-human organism or part thereof as non-polar lipid, and (b) recovering the extracted non-polar lipid, wherein steps (a) and (b) are performed prior to the step of converting at least some of the lipid in the vegetative plant part, or the non-human organism or part thereof to the industrial product. The proportion of non-polar lipid that is first extracted may be less than 50%, or more than 50%, or preferably at least 75% of the total non-polar lipid in the vegetative plant part, or non-human organism or part thereof. In this embodiment, the extracted non-polar lipid comprises triacylglycerols, wherein the triacylglycerols comprise at least 90%, preferably at least 95% of the extracted lipid. The extracted lipid may itself be converted to an industrial product other than the lipid itself, for example by trans-esterification to fatty acid esters.

In a second aspect, the invention provides a process for producing extracted lipid from a non-human organism or a part thereof.

In an embodiment, the present invention provides a process for producing extracted lipid, the process comprising the steps of:

i) obtaining a non-human organism or a part thereof, wherein the non-human organism or part thereof has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight or seed weight), ii) extracting lipid from the non-human organism or part thereof, and iii) recovering the extracted lipid, thereby producing the extracted lipid, wherein one or more or all of the following features apply:

(a) the non-human organism or a part thereof comprises one or more exogenous polynucleotide(s) and an increased level of one or more non-polar lipid(s) relative to a corresponding non-human organism or a part thereof, respectively, lacking the one or more exogenous polynucleotide(s), wherein each of the one or more exogenous polynucleotides is operably linked to a promoter which is capable of directing expression of the polynucleotide in a non-human organism or part thereof, (b) the non-human organism is an alga selected from the group consisting of diatoms (bacillariophytes), green algae (chlorophytes), blue-green algae (cyanophytes), golden-brown algae (chrysophytes), haptophytes, brown algae and heterokont algae, (c) the one or more non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, (d) the total fatty acid content in the non-polar lipid(s) comprises at least 2% more oleic acid and/or at least 2% less palmitic acid than the non-polar lipid(s) in the corresponding non-human organism or part thereof lacking the one or more exogenous polynucleotides of part (a), (e) the non-polar lipid(s) comprise a modified level of total sterols, preferably free (non-esterified) sterols, steroyl esters, steroyl glycosides, relative to the non-polar lipid(s) in the corresponding non-human organism or part thereof lacking the one or more exogenous polynucleotides of part (a), (f) the non-polar lipid(s) comprise waxes and/or wax esters, (g) the non-human organism or part thereof is one member of a pooled population or collection of at least about 1000 such non-human organisms or parts thereof, respectively, from which the lipid is extracted.

In another embodiment, the invention provides a process for producing extracted lipid, the process comprising the steps of:

i) obtaining a non-human organism or a part thereof comprising one or more exogenous polynucleotide(s) and an increased level of one or more non-polar lipid(s) relative to a corresponding non-human organism or a part thereof, respectively, lacking the one or more exogenous polynucleotide(s), ii) extracting lipid from the non-human organism or part thereof, and iii) recovering the extracted lipid, thereby producing the extracted lipid, wherein each of the one or more exogenous polynucleotides is operably linked to a promoter which is capable of directing expression of the polynucleotide in a non-human organism or part thereof, and wherein one or more or all of the following features apply:

(a) the one or more exogenous polynucleotide(s) comprise a first exogenous polynucleotide which encodes an RNA or transcription factor polypeptide that increases the expression of one or more glycolytic or fatty acid biosynthetic genes in a non-human organism or a part thereof, and a second exogenous polynucleotide which encodes an RNA or polypeptide involved in biosynthesis of one or more non-polar lipids, (b) if the non-human organism is a plant, a vegetative part of the plant has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight), (c) the non-human organism is an alga selected from the group consisting of diatoms (bacillariophytes), green algae (chlorophytes), blue-green algae (cyanophytes), golden-brown algae (chrysophytes), haptophytes, brown algae and heterokont algae, (d) the one or more non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, (e) the total fatty acid content in the non-polar lipid(s) comprises at least 2% more oleic acid and/or at least 2% less palmitic acid than the non-polar lipid(s) in the corresponding non-human organism or part thereof lacking the one or more exogenous polynucleotides, (f) the non-polar lipid(s) comprise a modified level of total sterols, preferably free (non-esterified) sterols, steroyl esters, steroyl glycosides, relative to the non-polar lipid(s) in the corresponding non-human organism or part thereof lacking the one or more exogenous polynucleotides, (g) the non-polar lipid(s) comprise waxes and/or wax esters, (h) the non-human organism or part thereof is one member of a pooled population or collection of at least 1000 such non-human organisms or parts thereof, respectively, from which the lipid is extracted.

In an embodiment of (b) above, the total non-polar lipid content is between 5% and 25%, between 7% and 25%, between 10% and 25%, between 12% and 25%, between 15% and 25%, between 7% and 20%, between 10% and 20%, about 10%, about 11%, about 12%, about 13%, about 14%, about 15%, about 16%, about 17%, about 18%, about 20%, or about 22%, each as a percentage of dry weight.

In an embodiment, the non-human organism is an alga, or an organism suitable for fermentation such as a fungus, or preferably a plant. The part of the non-human organism may be a seed, fruit, or a vegetative part of a plant. In a preferred embodiment, the plant part is a leaf portion having a surface area of at least 1 cm². In another preferred embodiment, the non-human organism is a plant, the part is a plant seed and the extracted lipid is seedoil. In a more preferred embodiment, the plant is from an oilseed species, which is used commercially or could be used commercially for oil production. The species may be selected from a group consisting of a *Acrocomia aculeata* (macauba palm), *Arabidopsis thaliana*, *Aracinis hypogaea* (peanut), *Astrocaryum murumuru* (murumuru), *Astrocaryum vulgare* (tucumã), *Attalea geraensis* (Indaiá-rateiro), *Attalea humilis* (American oil palm), *Attalea oleifera* (andaiá), *Attalea phalerata* (uricuri), *Attalea speciosa* (babassu), *Avena sativa* (oats), *Beta vulgaris* (sugar beet), *Brassica* sp. such as *Brassica carinata*, *Brassica juncea*, *Brassica napobrassica*, *Brassica napus* (canola), *Camelina sativa* (false flax), *Cannabis sativa* (hemp), *Carthamus tinctorius* (safflower), *Caryocar brasiliense* (pequi), *Cocos nucifera* (Coconut), *Crambe abyssinica* (Abyssinian kale), *Cucumis melo* (melon), *Elaeis guineensis* (African palm), *Glycine max* (soybean), *Gossypium hirsutum* (cotton), *Helianthus* sp. such as *Helianthus annuus* (sunflower), *Hordeum vulgare* (barley), *Jatropha curcas* (physic nut), *Joannesia princeps* (arara nut-tree), *Lemna* sp. (duckweed) such as *Lemna aequinoctialis*, *Lemna disperma*, *Lemna ecuadoriensis*, *Lemna gibba* (swollen duckweed), *Lemna japonica*, *Lemna minor*, *Lemna minuta*, *Lemna obscura*, *Lemna paucicostata*, *Lemna perpusilla*, *Lemna tenera*, *Lemna trisulca*, *Lemna turionifera*, *Lemna valdiviana*, *Lemna yungensis*, *Licania rigida* (oiticica), *Linum usitatissimum* (flax), *Lupinus angustifolius* (lupin), *Mauritia flexuosa* (buriti palm), *Maximiliana maripa* (inaja palm), *Miscanthus* sp. such as *Miscanthus×giganteus* and *Miscanthus sinensis*, *Nicotiana* sp. (tabacco) such as *Nicotiana tabacum* or *Nicotiana benthamiana*, *Oenocarpus bacaba* (bacaba-do-azeite), *Oenocarpus bataua* (patauã), *Oenocarpus distichus* (bacaba-de-leque), *Oryza* sp. (rice) such as *Oryza sativa* and *Oryza glaberrima*, *Panicum virgatum* (switchgrass), *Paraqueiba paraensis* (mari), *Persea amencana* (avocado), *Pongamia pinnata* (Indian beech), *Populus trichocarpa*, *Ricinus communis* (castor), *Saccharum* sp. (sugarcane), *Sesamum indicum* (sesame), *Solanum tuberosum* (potato), *Sorghum* sp. such as *Sorghum bicolor*, *Sorghum vulgare*, *Theobroma grandiforum* (cupuassu), *Trifolium* sp., *Trithrinax brasiliensis* (Brazilian needle palm), *Triticum* sp. (wheat) such as *Triticum aestivum* and *Zea mays* (corn). In an embodiment, the *Brassica napus* plant is of the variety Westar. In an alternative embodiment, if the plant is *Brassica napus*, it is of a variety or cultivar other than Westar. In an embodiment, the plant is of a species other than *Arabidopsis thaliana*. In another embodiment, the plant is of a species other than *Nicotiana tabacum*. In another embodiment, the plant is of a species other than *Nicotiana benthamiana*. In one embodiment, the plant is a perennial, for example, a switchgrass. Each of the features described for the plant of the second aspect can be applied mutatis mutandis to the vegetative plant part of the first aspect.

In an embodiment, the non-human organism is an oleaginous fungus such as an oleaginous yeast.

In a preferred embodiment, the lipid is extracted without drying the non-human organism or part thereof prior to the extraction. The extracted lipid may subsequently be dried or fractionated to reduce its moisture content.

In further embodiments of this aspect, the invention provides a process for producing extracted lipid from specific oilseed plants. In an embodiment, the invention provides a process for producing extracted canola oil, the process comprising the steps of:
  i) obtaining canola seed comprising at least 45% seedoil on a weight basis,
  ii) extracting oil from the canola seed, and
  iii) recovering the oil, wherein the recovered oil comprises at least 90% (w/w) triacylglycerols (TAG),
thereby producing the canola oil. In a preferred embodiment, the canola seed has an oil content on a weight basis of at least 46%, at least 47%, at least 48%, at least 49%, at least 50%, at least 51%, at least 52%, at least 53%, at least 54%, at least 55% or at least 56%. The oil content is determinable by measuring the amount of oil that is extracted from the seed, which is threshed seed as commonly harvested, and calculated as a percentage of the seed weight, i.e., % (w/w). Moisture content of the canola seed is between 5% and 15%, and is preferably about 8.5%. In an embodiment, the oleic acid content is between about 58% and 62% of the total fatty acid in the canola oil, preferably at least 63%, and the palmitic acid content is about 4% to about 6% of the total fatty acids in the canola oil. Preferred canola oil has an iodine value of 110-120 and a chlorophyll level of less than 30 ppm.

In another embodiment, the invention provides a process for producing extracted cornseed oil, the process comprising the steps of:
  i) obtaining corn seed comprising at least 5% seedoil on a weight basis,
  ii) extracting oil from the corn seed, and
  iii) recovering the oil, wherein the recovered oil comprises at least 80%, preferably at least 85% or at least 90% (w/w) triacylglycerols (TAG),
thereby producing the cornseed oil. In a preferred embodiment, the corn seed has an oil content on a seed weight basis (w/w) of at least 6%, at least 7%, at least 8%, at least 9%, at least 10%, at least 11%, at least 12% or at least 13%. The moisture content of the cornseed is about 13% to about 17%, preferably about 15%. Preferred corn oil comprises about 0.1% tocopherols.

In another embodiment, the invention provides a process for producing extracted soybean oil, the process comprising the steps of:
  i) obtaining soybean seed comprising at least 20% seedoil on a weight basis,
  ii) extracting oil from the soybean seed, and
  iii) recovering the oil, wherein the recovered oil comprises at least 90% (w/w) triacylglycerols (TAG),
thereby producing the soybean oil. In a preferred embodiment, the soybean seed has an oil content on a seed weight basis (w/w) of at least 21%, at least 22%, at least 23%, at least 24%, at least 25%, at least 26%, at least 27%, at least 28%, at least 29%, at least 30%, or at least 31%. In an embodiment, the oleic acid content is between about 20% and about 25% of the total fatty acid in the soybean oil, preferably at least 30%, the linoleic acid content is between about 45% and about 57%, preferably less than 45%, and the palmitic acid content is about 10% to about 15% of the total fatty acids in the soybean oil, preferably less than 10%. Preferably the soybean seed has a protein content of about 40% on a dry weight basis, and the moisture content of the soybean seed is about 10% to about 16%, preferably about 13%.

In another embodiment, the invention provides a process for producing extracted lupinseed oil, the process comprising the steps of:
  i) obtaining lupin seed comprising at least 10% seedoil on a weight basis,
  ii) extracting oil from the lupin seed, and
  iii) recovering the oil, wherein the recovered oil comprises at least 90% (w/w) triacylglycerols (TAG),
thereby producing the lupinseed oil. In a preferred embodiment, the lupin seed has an oil content on a seed weight basis (w/w) of at least 11%, at least 12%, at least 13%, at least 14%, at least 15%, or at least 16%.

In another embodiment, the invention provides a process for producing extracted peanut oil, the process comprising the steps of:
i) obtaining peanuts comprising at least 50% seedoil on a weight basis,
ii) extracting oil from the peanuts, and
iii) recovering the oil, wherein the recovered oil comprises at least 90% (w/w) triacylglycerols (TAG), thereby producing the peanut oil. In a preferred embodiment, the peanut seed (peanuts) have an oil content on a seed weight basis (w/w) of at least 51%, at least 52%, at least 53%, at least 54%, at least 55% or at least 56%. In an embodiment, the oleic acid content is between about 38% and 59% of the total fatty acid in the peanut oil, preferably at least 60%, and the palmitic acid content is about 9% to about 13% of the total fatty acids in the peanut oil, preferably less than 9%.

In another embodiment, the invention provides a process for producing extracted sunflower oil, the process comprising the steps of:
i) obtaining sunflower seed comprising at least 50% seedoil on a weight basis,
ii) extracting oil from the sunflower seed, and
iii) recovering the oil, wherein the recovered oil comprises at least 90% (w/w) triacylglycerols (TAG), thereby producing the sunflower oil. In a preferred embodiment, the sunflower seed have an oil content on a seed weight basis (w/w) of at least 51%, at least 52%, at least 53%, at least 54%, or at least 55%.

In another embodiment, the invention provides a process for producing extracted cottonseed oil, the process comprising the steps of:
i) obtaining cottonseed comprising at least 41% seedoil on a weight basis,
ii) extracting oil from the cottonseed, and
iii) recovering the oil, wherein the recovered oil comprises at least 90% (w/w) triacylglycerols (TAG), thereby producing the cottonseed oil. In a preferred embodiment, the cotton seed have an oil content on a seed weight basis (w/w) of at least 42%, at least 43%, at least 44%, at least 45%, at least 46%, at least 47%, at least 48%, at least 49%, or at least 50%. In an embodiment, the oleic acid content is between about 15% and 22% of the total fatty acid in the cotton oil, preferably at least 22%, the linoleic acid content is between about 45% and about 57%, preferably less than 45%, and the palmitic acid content is about 20% to about 26% of the total fatty acids in the cottonseed oil, preferably less than 18%. In an embodiment, the cottonseed oil also contains cyclopropanated fatty acids such as sterculic and malvalic acids, and may contain small amounts of gossypol.

In another embodiment, the invention provides a process for producing extracted safflower oil, the process comprising the steps of:
i) obtaining safflower seed comprising at least 35% seedoil on a weight basis,
ii) extracting oil from the safflower seed, and
iii) recovering the oil, wherein the recovered oil comprises at least 90% (w/w) triacylglycerols (TAG), thereby producing the safflower oil. In a preferred embodiment, the safflower seed have an oil content on a seed weight basis (w/w) of at least 36%, at least 37%, at least 38%, at least 39%, at least 40%, at least 41%, at least 42%, at least 43%, at least 44%, or at least 45%.

In another embodiment, the invention provides a process for producing extracted flaxseed oil, the process comprising the steps of:
i) obtaining flax seed comprising at least 36% seedoil on a weight basis,
ii) extracting oil from the flax seed, and
iii) recovering the oil, wherein the recovered oil comprises at least 90% (w/w) triacylglycerols (TAG), thereby producing the flaxseed oil. In a preferred embodiment, the flax seed have an oil content on a seed weight basis (w/w) of at least 37%, at least 38%, at least 39%, or at least 40%.

In another embodiment, the invention provides a process for producing extracted *Camelina* oil, the process comprising the steps of:
i) obtaining *Camelina sativa* seed comprising at least 36% seedoil on a weight basis,
ii) extracting oil from the *Camelina sativa* seed, and
iii) recovering the oil, wherein the recovered oil comprises at least 90% (w/w) triacylglycerols (TAG), thereby producing the *Camelina* oil. In a preferred embodiment, the *Camelina sativa* seed have an oil content on a seed weight basis (w/w) of at least 37%, at least 38%, at least 39%, at least 40%, at least 41%, at least 42%, at least 43%, at least 44%, or at least 45%.

The process of the second aspect may also comprise measuring the oil and/or protein content of the seed by near-infrared reflectance spectroscopy as described in Hom et al. (2007).

In an embodiment, the process of the second aspect of the invention comprises partially or completely drying the vegetative plant part, or the non-human organism, or part thereof, or the seed, and/or one or more of rolling, pressing such as flaking, crushing or grinding the vegetative plant part, or the non-human organism or part thereof, or the seed, or any combination of these methods, in the extraction process. The process may use an organic solvent (e.g., hexane such as n-hexane or a combination of n-hexane with isohexane, or butane alone or in combination with hexane) in the extraction process to extract the lipid or oil or to increase the efficiency of the extraction process, particularly in combination with a prior drying process to reduce the moisture content.

In an embodiment, the process comprises recovering the extracted lipid or oil by collecting it in a container, and/or purifying the extracted lipid or seedoil, such as, for example, by degumming, deodorising, decolourising, drying and/or fractionating the extracted lipid or oil, and/or removing at least some, preferably substantially all, waxes and/or wax esters from the extracted lipid or oil. The process may comprise analysing the fatty acid composition of the extracted lipid or oil, such as, for example, by converting the fatty acids in the extracted lipid or oil to fatty acid methyl esters and analysing these using GC to determine the fatty acid composition. The fatty acid composition of the lipid or oil is determined prior to any fractionation of the lipid or oil that alters its fatty acid composition. The extracted lipid or oil may comprise a mixture of lipid types and/or one or more derivatives of the lipids, such as free fatty acids.

In an embodiment, the process of the second aspect of the invention results in substantial quantities of extracted lipid or oil. In an embodiment, the volume of the extracted lipid or oil is at least 1 litre, preferably at least 10 litres. In a preferred embodiment, the extracted lipid or oil is packaged ready for transportation or sale.

In an embodiment, the extracted lipid or oil comprises at least 91%, at least 92%, at least 93%, at least 94%, at least 95% or at least 96% TAG on a weight basis. The extracted lipid or oil may comprise phospholipid as a minor component, up to about 8% by weight, preferably less than 5% by weight, and more preferably less than 3% by weight.

In an embodiment, the process results in extracted lipid or oil wherein one or more or all of the following features apply:

(i) triacylglycerols comprise at least 90%, preferably at least 95% or 96%, of the extracted lipid or oil, (ii) the extracted lipid or oil comprises free sterols, steroyl esters, steroyl glycosides, waxes or wax esters, or any combination thereof, and (iii) the total sterol content and/or composition in the extracted lipid or oil is significantly different to the sterol content and/or composition in the extracted lipid or oil produced from a corresponding non-human organism or part thereof, or seed.

In an embodiment, the process further comprises converting the extracted lipid or oil to an industrial product. That is, the extracted lipid or oil is converted post-extraction to another chemical form which is an industrial product. Preferably, the industrial product is a hydrocarbon product such as fatty acid esters, preferably fatty acid methyl esters and/or fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar.

In the process of either the first or second aspects of the invention, the vegetative plant part, or the part of the non-human organism may be an aerial plant part or a green plant part such as a plant leaf or stem, a woody part such as a stem, branch or trunk, or a root or tuber. Preferably, the plants are grown in a field and the parts such as seed harvested from the plants in the field.

In an embodiment, the process further comprises a step of harvesting the vegetative plant part, non-human organism or part thereof, preferably with a mechanical harvester.

Preferably, the vegetative plant parts are harvested at a time when the yield of non-polar lipids are at their highest. In one embodiment, the vegetative plant parts are harvested about at the time of flowering. In another embodiment, the vegetative plant parts are harvested from about at the time of flowering to about the beginning of senescence. In another embodiment, the vegetative plant parts are harvested when the plants are at least about 1 month of age.

If the organism is an algal or fungal organism, the cells may be grown in an enclosed container or in an open-air system such as a pond. The resultant organisms comprising the non-polar lipid may be harvested, such as, for example, by a process comprising filtration, centrifugation, sedimentation, flotation or flocculation of algal or fungal organisms such as by adjusting pH of the medium. Sedimentation is less preferred.

In the process of the second aspect of the invention, the total non-polar lipid content of the non-human organism or part thereof, such a vegetative plant part or seed, is increased relative to a corresponding vegetative plant part, non-human organism or part thereof, or seed.

In an embodiment, the vegetative plant part, or non-human organism or part thereof, or seed of the first or second aspects of the invention is further defined by three features, namely Feature (i), Feature (ii) and Feature (iii), singly or in combination:

Feature (i) quantifies the extent of the increased level of the one or more non-polar lipids or the total non-polar lipid content of the vegetative plant part, or non-human organism or part thereof, or seed which may be expressed as the extent of increase on a weight basis (dry weight basis or seed weight basis), or as the relative increase compared to the level in the corresponding vegetative plant part, or non-human organism or part thereof, or seed. Feature (ii) specifies the plant genus or species, or the fungal or algal species, or other cell type, and Feature (iii) specifies one or more specific lipids that are increased in the non-polar lipid content.

For Feature (i), in an embodiment, the extent of the increase of the one or more non-polar lipids is at least 0.5%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25% or at least 26% greater on a dry weight or seed weight basis than the corresponding vegetative plant part, or non-human organism or part thereof.

Also for Feature (i), in a preferred embodiment, the total non-polar lipid content of the vegetative plant part, or non-human organism or part thereof, or seed is increased when compared to the corresponding vegetative plant part, or non-human organism or part thereof, or seed. In an embodiment, the total non-polar lipid content is increased by at least 0.5%, at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25% or at least 26% greater on a dry weight or seed weight basis than the corresponding vegetative plant part, or non-human organism or part thereof, or seed.

Further, for Feature (i), in an embodiment, the level of the one or more non-polar lipids and/or the total non-polar lipid content is at least 1%, at least 2%, at least 3%, at least 4%, at least 5%, at least 6%, at least 7%, at least 8%, at least 9%, at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 30%, at least 35%, at least 40%, at least 45%, at least 50%, at least 60%, at least 70%, at least 80%, at least 90%, or at least 100% greater on a relative basis than the corresponding vegetative plant part, or non-human organism or part thereof, or seed.

Also for Feature (i), the extent of increase in the level of the one or more non-polar lipids and/or the total non-polar lipid content may be at least 2-fold, at least 3-fold, at least 4-fold, at least 5-fold, at least 6-fold, at least 7-fold, at least 8-fold, at least 9-fold, at least 10-fold, or at least 12-fold, preferably at least about 13-fold or at least about 15-fold greater on a relative basis than the corresponding vegetative plant part, or non-human organism or part thereof, or seed.

As a result of the increase in the level of the one or more non-polar lipids and/or the total non-polar lipid content as defined in Feature (i), the total non-polar lipid content of the vegetative plant part, or non-human organism or part thereof, or seed is preferably between 5% and 25%, between 7% and 25%, between 10% and 25%, between 12% and 25%, between 15% and 25%, between 7% and 20%, between 10% and 20%, about 10%, about 11%, about 12%, about 13%, about 14%, about 15%, about 16%, about 17%, about 18%, about 20%, or about 22%, each as a percentage of dry weight or seed weight.

For Feature (ii), in an embodiment, the non-human organism is a plant, alga, or an organism suitable for fermentation such as a yeast or other fungus, preferably an oleaginous fungus such as an oleaginous yeast. The plant may be, or the vegetative plant part may be from, for example, a plant which is *Acrocomia aculeata* (macauba palm), *Arabidopsis thaliana, Aracinis hypogaea* (peanut), *Astrocaryum murumuru* (murumuru), *Astrocaryum vulgare* (tucumã), *Attalea geraensis* (Indaiá-rateiro), *Attalea humilis* (American oil palm), *Attalea oleifera* (andaiá), *Attalea phalerata* (uricuri),

*Attalea speciosa* (babassu), *Avena sativa* (oats), *Beta vulgaris* (sugar beet), *Brassica* sp. such as *Brassica carinata, Brassica juncea, Brassica napobrassica, Brassica napus* (canola), *Camelina sativa* (false flax), *Cannabis sativa* (hemp), *Carthamus tinctorius* (safflower), *Caryocar brasiliense* (pequi), *Cocos nucifera* (Coconut), *Crambe abyssinica* (Abyssinian kale), *Cucumis melo* (melon), *Elaeis guineensis* (African palm), *Glycine max* (soybean), *Gossypium hirsutum* (cotton), *Helianthus* sp. such as *Helianthus annuus* (sunflower), *Hordeum vulgare* (barley), *Jatropha curcas* (physic nut), *Joannesia princeps* (arara nut-tree), *Lemna* sp. (duckweed) such as *Lemna aequinoctialis, Lemna disperma, Lemna ecuadoriensis, Lemna gibba* (swollen duckweed), *Lemna japonica, Lemna minor, Lemna minuta, Lemna obscura, Lemna paucicostata, Lemna perpusilla, Lemna tenera, Lemna trisulca, Lemna turionifera, Lemna valdiviana, Lemna yungensis, Licania rigida* (oiticica), *Linum usitatissimum* (flax), *Lupinus angustifolius* (lupin), *Mauritia flexuosa* (buriti palm), *Maximiliana maripa* (inaja palm), *Miscanthus* sp. such as *Miscanthus×giganteus* and *Miscanthus sinensis, Nicotiana* sp. (tabacco) such as *Nicotiana tabacum* or *Nicotiana benthamiana, Oenocarpus bacaba* (bacaba-do-azeite), *Oenocarpus bataua* (patauã), *Oenocarpus distichus* (bacaba-de-leque), *Oryza* sp. (rice) such as *Oryza sativa* and *Oryza glaberrima, Panicum virgatum* (switchgrass), *Paraqueiba paraensis* (mari), *Persea amencana* (avocado), *Pongamia pinnata* (Indian beech), *Populus trichocarpa, Ricinus communis* (castor), *Saccharum* sp. (sugarcane), *Sesamum indicum* (sesame), *Solanum tuberosum* (potato), *Sorghum* sp. such as *Sorghum bicolor, Sorghum vulgare, Theobroma grandiforum* (cupuassu), *Trifolium* sp., *Trithrinax brasiliensis* (Brazilian needle palm), *Triticum* sp. (wheat) such as *Triticum aestivum* and *Zea mays* (corn). In an embodiment, the *Brassica napus* plant is of the variety Westar. In an alternative embodiment, if the plant is *Brassica napus*, it is of a variety or cultivar other than Westar. In an embodiment, the plant is of a species other than *Arabidopsis thaliana*. In another embodiment, the plant is of a species other than *Nicotiana tabacum*. In another embodiment, the plant is of a species other than *Nicotiana benthamiana*. In one embodiment, the plant is a perennial, for example, a switchgrass. Each of the features described for the plant of the second aspect can be applied mutatis mutandis to the vegetative plant part of the first aspect.

For Feature (iii), TAG, DAG, TAG and DAG, MAG, total polyunsaturated fatty acid (PUFA), or a specific PUFA such as eicosadienoic acid (EDA), arachidonic acid (ARA), alpha linolenic acid (ALA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA), or a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, is/are increased or decreased. The extent of the increase of TAG, DAG, TAG and DAG, MAG, PUFA, specific PUFA, or fatty acid, is as defined in Feature (i) above. In a preferred embodiment, the MAG is 2-MAG. Preferably, DAG and/or TAG, more preferably the total of DAG and TAG, or MAG and TAG, are increased. In an embodiment, TAG levels are increased without increasing the MAG and/or DAG content.

Also for Feature (iii), in an embodiment, the total fatty acid content and/or TAG content of the total non-polar lipid content comprises (a) at least 2% more, preferably at least 5% more, more preferably at least 7% more, most preferably at least 10% more, at least 15% more, at least 20% more, at least 25% more oleic acid, or at least 30% more relative to the non-polar lipid(s) in the corresponding vegetative plant part, or non-human organism or part thereof, or seed lacking the one or more exogenous polynucleotides. In an embodiment, the total fatty acid content in the non-polar lipid(s) comprises (b) at least 2% less, preferably at least 4% less, more preferably at least 7% less, at least 10% less, at least 15% less, or at least 20% less palmitic acid relative to the non-polar lipid(s) in the corresponding vegetative plant part, or non-human organism or part thereof, or seed lacking the one or more exogenous polynucleotides. In an embodiment, the total fatty acid content of the total non-polar lipid content comprises (c) at least 2% less, preferably at least 4% less, more preferably at least 7% less, at least 10% less, or at least 15% less ALA relative to the non-polar lipid(s) in the corresponding vegetative plant part, or non-human organism or part thereof, or seed lacking the one or more exogenous polynucleotides. In an embodiment, the total fatty acid content of the total non-polar lipid content comprises (d) at least 2% more, preferably at least 5% more, more preferably at least 7% more, most preferably at least 10% more, or at least 15% more, LA, relative to the non-polar lipid(s) in the corresponding vegetative plant part, or non-human organism or part thereof, or seed lacking the one or more exogenous polynucleotides. Most preferably, the total fatty acid and/or TAG content of the total non-polar lipid content has an increased oleic acid level according to a figure defined in (a) and a decreased palmitic acid content according to a figure defined in (b). In an embodiment, the total sterol content is increased by at least 10% relative to seedoil from a corresponding seed. In an embodiment, the extracted lipid or oil comprises at least 10 ppm chlorophyll, preferably at least 30 ppm chlorophyll. The chlorophyll may subsequently be removed by de-colourising the extracted lipid or oil.

In preferred embodiments, the one or more non-polar lipids and/or the total non-polar lipid content is defined by the combination of Features (i), (ii) and (iii), or Features (i) and (ii), or Features (i) and (iii), or Features (ii) and (iii).

The process of the second aspect of the invention provides, in an embodiment, that one or more or all of the following features apply:

(i) the level of one or more non-polar lipids in the vegetative plant part, or non-human organism or part thereof, or seed is at least 0.5% greater on a weight basis than the level in a corresponding vegetative plant part, non-human organism or part thereof, or seed, respectively, lacking the one or more exogenous polynucleotide(s), or preferably as further defined in Feature (i), (ii) the level of one or more non-polar lipids in the vegetative plant part, non-human organism or part thereof, or seed is at least 1% greater on a relative basis than in a corresponding vegetative plant part, non-human organism or part thereof, or seed, respectively, lacking the one or more exogenous polynucleotide(s), or preferably as further defined in Feature (i), (iii) the total non-polar lipid content in the vegetative plant part, non-human organism or part thereof, or seed is at least 0.5% greater on a weight basis than the level in a corresponding vegetative plant part, non-human organism or part thereof, or seed, respectively, lacking the one or more exogenous polynucleotide(s), or preferably as further defined in Feature (i), (iv) the total non-polar lipid content in the vegetative plant part, non-human organism or part thereof, or seed is at least 1% greater on a relative basis than in a corresponding vegetative plant part, non-human organism or part thereof, or seed, respectively, lacking the one or more exogenous polynucleotide(s), or preferably as further defined in Feature (i), (v) the level of one or more non-polar lipids and/or the total non-polar lipid content of the vegetative plant part, non-human organism or part thereof, or seed, is at least 0.5% greater on a weight basis and/or at least 1% greater on a relative basis than a corresponding vegetative plant part, non-human organism or a part thereof, or seed, respectively, which is lacking the one or more exogenous polynucleotides and which comprises an exogenous polynucleotide encoding an *Arabidopsis thaliana* DGAT1, or preferably as further defined in Feature (i), (vi) the TAG, DAG, TAG and DAG, or MAG content in the lipid in the vegetative plant part, non-human organism or part thereof, or seed, and/or in the extracted lipid therefrom, is at least 10% greater on a relative basis than the TAG, DAG, TAG and DAG, or MAG content in the lipid in a corresponding vegetative plant part, non-human organism or a part thereof, or seed lacking the one or more exogenous polynucleotide(s), or a corresponding extracted lipid therefrom, respectively, or preferably as further defined in Feature (i), and (vii) the total polyunsaturated fatty acid (PUFA) content in the lipid in the vegetative plant part, non-human organism or part thereof, or seed and/or in the extracted lipid therefrom, is increased (e.g., in the presence of a MGAT) or decreased (e.g., in the absence of a MGAT) relative to the total PUFA content in the lipid in a corresponding vegetative plant part, non-human organism or part thereof, or seed lacking the one or more exogenous polynucleotide(s), or a corresponding extracted lipid therefrom, respectively, or preferably as further defined in Feature (i) or Feature (iii).

In an embodiment, the level of a PUFA in the vegetative plant part, non-human organism or part thereof, or seed and/or the extracted lipid therefrom, is increased relative to the level of the PUFA in a corresponding vegetative plant part, non-human organism or part thereof, or seed, or a corresponding extracted lipid therefrom, respectively, wherein the polyunsaturated fatty acid is eicosadienoic acid, arachidonic acid (ARA), alpha linolenic acid (ALA), stearidonic acid (SDA), eicosatrienoic acid (ETE), eicosatetraenoic acid (ETA), eicosapentaenoic acid (EPA), docosapentaenoic acid (DPA), docosahexaenoic acid (DHA), or a combination of two of more thereof. Preferably, the extent of the increase is as defined in Feature (i).

In an embodiment of the second aspect, the corresponding vegetative plant part, or non-human organism or part thereof, or seed is a non-transgenic vegetative plant part, or non-human organism or part thereof, or seed, respectively. In a preferred embodiment, the corresponding vegetative plant part, or non-human organism or part thereof, or seed is of the same cultivar, strain or variety but lacking the one or more exogenous polynucleotides. In a further preferred embodiment, the corresponding vegetative plant part, or non-human organism or part thereof, or seed is at the same developmental stage, for example, flowering, as the vegetative plant part, or non-human organism or part thereof, or seed. In another embodiment, the vegetative plant parts are harvested from about at the time of flowering to about the beginning of senescence. In another embodiment, the seed is harvested when the plants are at least about 1 month of age.

In an embodiment, part of the non-human organism is seed and the total oil content, or the total fatty acid content, of the seed is at least 0.5% to 25%, or at least 1.0% to 24%, greater on a weight basis than a corresponding seed lacking the one or more exogenous polynucleotides.

In an embodiment, the relative DAG content of the seedoil is at least 10%, at least 10.5%, at least 11%, at least 11.5%, at least 12%, at least 12.5%, at least 13%, at least 13.5%, at least 14%, at least 14.5%, at least 15%, at least 15.5%, at least 16%, at least 16.5%, at least 17%, at least 17.5%, at least 18%, at least 18.5%, at least 19%, at least 19.5%, at least 20% greater on a relative basis than of seedoil from a corresponding seed. In an embodiment, the DAG content of the seed is increased by an amount as defined in Feature (i) and the seed is from a genus and/or species as defined in Feature (ii).

In an embodiment, the relative TAG content of the seed is at least 5%, at least 5.5%, at least 6%, at least 6.5%, at least 7%, at least 7.5%, at least 8%, at least 8.5%, at least 9%, at least 9.5%, at least 10%, or at least 11% greater on an absolute basis relative to a corresponding seed. In an embodiment, the TAG content of the seed is increased by an amount as defined in Feature (i) and the seed is from a genus and/or species as defined in Feature (ii).

In another embodiment, the part of the non-human organism is a vegetative plant part and the TAG, DAG, TAG and DAG, or MAG content of the vegetative plant part is at least 10%, at least 11%, at least 12%, at least 13%, at least 14%, at least 15%, at least 16%, at least 17%, at least 18%, at least 19%, at least 20%, at least 21%, at least 22%, at least 23%, at least 24%, at least 25%, at least 30% at least 35%, at least 40%, at least 45%, at least 50%, at least 60%, at least 70%, at least 80%, at least 90%, or at least 100% greater on a relative basis than the TAG, DAG, TAG and DAG, or MAG content of a corresponding vegetative plant part lacking the one or more exogenous polynucleotides. In a preferred embodiment, the MAG is 2-MAG. In an embodiment, the TAG, DAG, TAG and DAG, or MAG content of the vegetative plant part is determined from the amount of these lipid components in the extractable lipid of the vegetative plant part. In a further embodiment, the TAG, DAG, TAG and DAG, or MAG content of the transgenic vegetative plant part is increased by an amount as defined in Feature (i).

In an embodiment, at least 20% (mol %), at least 22% (mol %), at least 30% (mol %), at least 40% (mol %), at least 50% (mol %) or at least 60% (mol %), preferably at least 65% (mol %), more preferably at least 66% (mol %), at least 67% (mol %), at least 68% (mol %), at least 69% (mol %) or at least 70% (mol %) of the fatty acid content of the total non-polar lipid content of the vegetative plant part, non-human organism or part thereof, or seed, or of the lipid or oil extracted therefrom, preferably of the TAG fraction, is oleic acid. Such high oleic contents are preferred for use in biodiesel applications.

In another embodiment, the PUFA content of the vegetative plant part, or non-human organism or part thereof, or seed is increased (e.g., in the presence of a MGAT) or decreased (e.g., in the absence of a MGAT) when compared to the corresponding vegetative plant part, or non-human organism or part thereof, or seed. In this context, the PUFA content includes both esterified PUFA (including TAG, DAG, etc.) and non-esterified PUFA. In an embodiment, the PUFA content of the vegetative plant part, or non-human organism or part thereof, or seed is preferably determined from the amount of PUFA in the extractable lipid of the vegetative plant part, or non-human organism or part thereof, or seed. The extent of the increase in PUFA content may be as defined in Feature (i). The PUFA content may comprise EDA, ARA, ALA, SDA, ETE, ETA, EPA, DPA, DHA, or a combination of two of more thereof.

In another embodiment, the level of a PUFA in the vegetative plant part, non-human organism or part thereof, or seed, or the lipid or oil extracted therefrom is increased or decreased when compared to the corresponding vegetative plant part, non-human organism or part thereof, or seed, or the lipid or oil extracted therefrom. The PUFA may be EDA, ARA, ALA, SDA, ETE, ETA, EPA, DPA, DHA, or a combination of two or more thereof. The extent of the increase in the PUFA may be as defined in Feature (i).

In another embodiment, the level of a fatty acid in the extracted lipid or oil is increased when compared to the lipid extracted from the corresponding vegetative plant part, or non-human organism or part thereof, or seed and wherein the fatty acid comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains. The extent of the increase in the fatty acid may be as defined in Feature (i).

In an embodiment, the level of the one or more non-polar lipids (such as TAG, DAG, TAG and DAG, MAG, PUFA, or a specific PUFA, or a specific fatty acid) and/or the total non-polar lipid content is determinable by analysis by using gas chromatography of fatty acid methyl esters obtained from the extracted lipid. Alternate methods for determining any of these contents are known in the art, and include methods which do not require extraction of lipid from the organism or part thereof, for example, analysis by near infrared (NIR) or nuclear magnetic resonance (NMR).

In a further embodiment, the level of the one or more non-polar lipids and/or the total non-polar lipid content of the vegetative plant part, or non-human organism or part thereof, or seed is at least 0.5% greater on a dry weight or seed weight basis and/or at least 1% greater on a relative basis, preferably at least 1% or 2% greater on a dry weight or seed weight basis, than a corresponding vegetative plant part, or non-human organism or a part thereof, or seed lacking the one or more exogenous polynucleotides but comprising an exogenous polynucleotide encoding an *Arabidopsis thaliana* DGAT1 (SEQ ID NO:83).

In yet a further embodiment, the vegetative plant part or the non-human organism or part thereof, or seed further comprises (i) one or more introduced mutations, and/or (ii) an exogenous polynucleotide which down-regulate the production and/or activity of an endogenous enzyme of the vegetative plant part or the non-human organism or part thereof, the endogenous enzyme being selected from a fatty acid acyl-transferase such as DGAT, sn-1 glycerol-3-phosphate acyl-transferase (sn-1 GPAT), 1-acyl-glycerol-3-phosphate acyl-transferase (LPAAT), acyl-CoA:lysophosphatidylcholine acyltransferase (LPCAT), phosphatidic acid phosphatase (PAP), an enzyme involved in starch biosynthesis such as (ADP)-glucose pyrophosphorylase (AGPase), a fatty acid desaturase such as a Δ12 fatty acid desaturase (FAD2), a polypeptide involved in the degradation of lipid and/or which reduces lipid content such as a lipase such as CGi58 polypeptide or SUGAR-DEPENDENT1 triacylglycerol lipase, or a combination of two or more thereof. In an alternative embodiment, the vegetative plant part or the non-human organism or part thereof does not comprise (i) above, or does not comprise (ii) above, or does not comprise (i) above and does not comprise (ii) above. In an embodiment, the exogenous polynucleotide which down-regulates the production of AGPase is not the polynucleotide disclosed in Sanjaya et al. (2011). In an embodiment, the exogenous polynucleotides in the vegetative plant part or the non-human organism or part thereof, or seed does not consist of an exogenous polynucleotide encoding a WRI1 and an exogenous polynucleotide encoding an RNA molecule which inhibits expression of a gene encoding an AGPase.

In the process of either the first or second aspects, the vegetative plant part, or non-human organism or part thereof, or seed, or the extracted lipid or oil, is further defined in preferred embodiments. Therefore, in an embodiment one or more or all of the following features apply (i) oleic acid comprises at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acid content in the non-polar lipid or oil in the vegetative plant part, non-human organism or part thereof, or seed, (ii) oleic acid comprises at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acid content in the extracted lipid or oil, (iii) the non-polar lipid or oil in the vegetative plant part, non-human organism or part thereof, or seed comprises a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, and (iv) the extracted lipid or oil comprises a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains. The fatty acid composition in this embodiment is measured prior to any modification of the fatty acid composition, such as, for example, by fractionating the extracted lipid or oil to alter the fatty acid composition. In preferred embodiments, the extent of the increase is as defined in Feature (i).

In an embodiment, the level of a lipid in the vegetative plant part, non-human organism or part thereof, or seed and/or in the extracted lipid or oil is determinable by analysis by using gas chromatography of fatty acid methyl esters prepared from the extracted lipid or oil. The method of analysis is preferably as described in Example 1 herein.

Again with respect to either the first or second aspects, the invention provides for one or more exogenous polynucleotides in the vegetative plant part, or non-human organism or part thereof, or seed used in the process. Therefore, in an embodiment, the vegetative plant part, or the non-human organism or part thereof, or the seed comprises a first exogenous polynucleotide which encodes an RNA or preferably a transcription factor polypeptide that increases the expression of one or more glycolytic or fatty acid biosynthetic genes in a vegetative plant part, or a non-human organism or a part thereof, or a seed, respectively, and a second exogenous polynucleotide which encodes an RNA or a polypeptide involved in biosynthesis of one or more non-polar lipids, wherein the first and second exogenous polynucleotides are each operably linked to a promoter which is capable of directing expression of the polynucleotide in a vegetative plant part, or a non-human organism or a part thereof, or a seed, respectively. That is, the first and second exogenous polynucleotides encode different factors which together provide for the increase in the non-polar lipid content in the vegetative plant part, or the non-human organism or part thereof, or the seed.

The increase is preferably additive, more preferably synergistic, relative to the presence of either the first or second exogenous polynucleotide alone. The factors encoded by the first and second polynucleotides operate by different mechanisms. Preferably, the transcription factor polypeptide increases the availability of substrates for non-polar lipid synthesis, such as, for example, increasing glycerol-3-phosphate and/or fatty acids preferably in the form of acyl-CoA, by increasing expression of genes, for example at least 5 or at least 8 genes, involved in glycolysis or fatty acid biosynthesis (such as, but not limited to, one or more of ACCase, sucrose transporters (SuSy, cell wall invertases), ketoacyl synthase (KAS), phosphofructokinase (PFK), pyruvate kinase (PK) (for example, (At5g52920, At3g22960), pyruvate dehydrogenase, hexose transporters (for example, GPT2 and PPT1), cytosolic fructokinase, cytosolic phosphoglycerate mutase, enoyl-ACP reductase (At2g05990), and phosphoglycerate mutase (At1g22170)) preferably more than one gene for each category. In an embodiment, the first exogenous polynucleotide encodes a Wrinkled 1 (WRI1) transcription factor, a Leafy Cotyledon 1 (Lec1) transcription factor, a Leafy Cotyledon 2 (LEC2) transcription factor, a Fus3 transcription factor, an ABI3 transcription factor, a Dof4 transcription factor, a BABY BOOM (BBM) transcription factor or a Dof11 transcription factor. In one embodiment, the LEC2 is not an *Arabidopsis* LEC2. As part of this embodiment, or separately, the second exogenous polynucleotide may encode a polypeptide having a fatty acid acyltransferase activity, for example, monoacylglycerol acyltransferase (MGAT) activity and/or diacylglycerol acyltransferase (DGAT) activity, or glycerol-3-phosphate acyltransferase (GPAT) activity. In one embodiment, the DGAT is not an *Arabidopsis* DGAT.

In a preferred embodiment, the vegetative plant part, or non-human organism or a part thereof, or the seed, of the first or second aspects of the invention comprises two or more exogenous polynucleotide(s), one of which encodes a transcription factor polypeptide that increases the expression of one or more glycolytic or fatty acid biosynthetic genes in the vegetative plant part, or non-human organism or a part thereof, or seed such as a Wrinkled 1 (WRI1) transcription factor, and a second of which encodes a polypeptide involved in biosynthesis of one or more non-polar lipids such as a DGAT.

In an embodiment, the vegetative plant part, non-human organism or a part thereof, or the seed of the first or second aspects of the invention may further comprise a third, or more, exogenous polynucleotide(s). The third, or more, exogenous polynucleotide(s) may encode one or more or any combination of:

i) a further RNA or transcription factor polypeptide that increases the expression of one or more glycolytic or fatty acid biosynthetic genes in a non-human organism or a part thereof (for example, if the first exogenous polynucleotide encodes a Wrinkled 1 (WRI1) transcription factor, the third exogenous polynucleotide may encode a LEC2 or BBM transcription factor (preferably, LEC2 or BBM expression controlled by an inducible promoter or a promoter which does not result in high transgene expression levels), ii) a further RNA or polypeptide involved in biosynthesis of one or more non-polar lipids (for example, if the second exogenous polynucleotide encodes a DGAT, the third exogenous polynucleotide may encode a MGAT or GPAT, or two further exogenous polynucleotides may be present encoding an MGAT and a GPAT), iii) a polypeptide that stabilizes the one or more non-polar lipids, preferably an oleosin, such as a polyoleosin or a caleosin, more preferably a polyoleosin, iv) an RNA molecule which inhibits expression of a gene encoding a polypeptide involved in starch biosynthesis such as a AGPase polypeptide, v) an RNA molecule which inhibits expression of a gene encoding a polypeptide involved in the degradation of lipid and/or which reduces lipid content such as a lipase such as CGi58 polypeptide or SUGAR-DEPENDENT1 triacylglycerol lipase, or vi) a silencing suppressor polypeptide, wherein the third, or more, exogenous polynucleotide(s) is operably linked to a promoter which is capable of directing expression of the polynucleotide(s) in a vegetative plant part, or a non-human organism or a part thereof, or a seed, respectively.

A number of specific combinations of genes are shown herein to be effective for increasing non-polar lipid contents. Therefore, regarding the process of either the first or second aspects of the invention, in an embodiment, the vegetative plant part, or the non-human organism or part thereof, or the seed comprises one or more exogenous polynucleotide(s) which encode:

i) a Wrinkled 1 (WRI1) transcription factor and a DGAT,
ii) a WRI1 transcription factor and a DGAT and an Oleosin,
iii) a WRI1 transcription factor, a DGAT, a MGAT and an Oleosin,
iv) a monoacylglycerol acyltransferase (MGAT),
v) a diacylglycerol acyltransferase 2 (DGAT2),
vi) a MGAT and a glycerol-3-phosphate acyltransferase (GPAT),
vii) a MGAT and a DGAT,
viii) a MGAT, a GPAT and a DGAT,
ix) a WRI1 transcription factor and a MGAT,
x) a WRI1 transcription factor, a DGAT and a MGAT,
xi) a WRI1 transcription factor, a DGAT, a MGAT, an Oleosin and a GPAT,
xii) a DGAT and an Oleosin, or
xiii) a MGAT and an Oleosin, and
xiv) optionally, a silencing suppressor polypeptide, wherein each of the one or more exogenous polynucleotide(s) is operably linked to a promoter which is capable of directing expression of the polynucleotide in a vegetative plant part, or a non-human organism or part thereof, or seed, respectively. Preferably the one or more exogenous polynucleotides are stably integrated into the genome of the vegetative plant part, or the non-human organism or part thereof, or the seed, and more preferably are present in a homozygous state. The polynucleotide may encode an enzyme having an amino acid sequence which is the same as a sequence of a naturally occurring enzyme of, for example, plant, yeast or animal origin. Further, the polynucleotide may encode an enzyme having one or more conservative mutations when compared to the naturally occurring enzyme.

In an embodiment,
(i) the GPAT also has phosphatase activity to produce MAG, such as a polypeptide having an amino acid sequence of *Arabidopsis* GPAT4 or GPAT6, and/or
(ii) the DGAT is a DGAT1 or a DGAT2, and/or
(iii) the MGAT is an MGAT1 or an MGAT2.

In a preferred embodiment, the vegetative plant part, the non-human organism or part thereof, or the seed comprises a first exogenous polynucleotide encoding a WRI1 and a second exogenous polynucleotide encoding a DGAT, preferably a DGAT1.

In another preferred embodiment, the vegetative plant part, the non-human organism or part thereof, or the seed comprises a first exogenous polynucleotide encoding a WRI1, a second exogenous polynucleotide encoding a DGAT, preferably a DGAT1, and a third exogenous polynucleotide encoding an oleosin.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an MGAT, preferably an MGAT2, and a fifth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an RNA molecule which inhibits expression of a gene encoding a lipase such as CGi58 polypeptide.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding an MGAT, preferably an MGAT2.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, a fifth exogenous polynucleotide encoding an MGAT, preferably an MGAT2, and a sixth exogenous polynucleotide encoding LEC2 or BBM.

In an embodiment, the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2. Preferably, the seed further comprises a fifth exogenous polynucleotide encoding a GPAT.

Where relevant, instead of a polynucleotide encoding an RNA molecule which inhibits expression of a gene encoding a lipase such as a CGi58 polypeptide, the vegetative plant part, the non-human organism or part thereof, or the seed has one or more introduced mutations in the lipase gene such as a CGi58 gene which confers reduced levels of the lipase polypeptide when compared to a corresponding vegetative plant part, non-human organism or part thereof, or seed lacking the mutation.

In a preferred embodiment, the exogenous polynucleotides encoding the DGAT and oleosin are operably linked to a constitutive promoter, or a promoter active in green tissues of a plant at least before and up until flowering, which is capable of directing expression of the polynucleotides in the vegetative plant part, the non-human organism or part thereof, or the seed. In a further preferred embodiment, the exogenous polynucleotide encoding WRI1, and RNA molecule which inhibits expression of a gene encoding a lipase such as a CGi58 polypeptide, is operably linked to a constitutive promoter, a promoter active in green tissues of a plant at least before and up until flowering, or an inducible promoter, which is capable of directing expression of the polynucleotides in the vegetative plant part, the non-human organism or part thereof, or the seed. In yet a further preferred embodiment, the exogenous polynucleotides encoding LEC2, BBM and/or MGAT2 are operably linked to an inducible promoter which is capable of directing expression of the polynucleotides in the vegetative plant part, the non-human organism or part thereof, or the seed.

In each of the above embodiments, the polynucleotides may be provided as separate molecules or may be provided as a contiguous single molecule, such as on a single T-DNA molecule. In an embodiment, the orientation of transcription of at least one gene on the T-DNA molecule is opposite to the orientation of transcription of at least one other gene on the T-DNA molecule.

In each of the above embodiments, the total non-polar lipid content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight). In a further preferred embodiment, the total non-polar lipid content is between 5% and 25%, between 7% and 25%, between 10% and 25%, between 12% and 25%, between 15% and 25%, between 7% and 20%, between 10% and 20%, between 10% and 15%, between 15% and 20%, between 20% and 25%, about 10%, about 11%, about 12%, about 13%, about 14%, about 15%, about 16%, about 17%, about 18%, about 20%, or about 22%, each as a percentage of dry weight or seed weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total TAG content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, or more preferably at least about 17% (w/w dry weight). In a further preferred embodiment, the total TAG content is between 5% and 30%, between 7% and 30%, between 10% and 30%, between 12% and 30%, between 15% and 30%, between 7% and 30%, between 10% and 30%, between 20% and 28%, between 18% and 25%, between 22% and 30%, about 10%, about 11%, about 12%, about 13%, about 14%, about 15%, about 16%, about 17%, about 18%, about 20%, or about 22%, each as a percentage of dry weight or seed weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total lipid content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, more preferably at least about 17% (w/w dry weight), more preferably at least about 20%, more preferably at least about 25%. In a further preferred embodiment, the total lipid content is between 5% and 35%, between 7% and 35%, between 10% and 35%, between 12% and 35%, between 15% and 35%, between 7% and 35%, between 10% and 20%, between 18% and 28%, between 20% and 28%, between 22% and 28%, about 10%, about 11%, about 12%, about 13%, about 14%, about 15%, about 16%, about 17%, about 18%, about 20%, about 22%, or about 25%, each as a percentage of dry weight. Typically, the total lipid content of the vegetative plant part, or non-human organism or part thereof is about 2-3% higher than the non-polar lipid content. In a particularly preferred embodiment, the vegetative plant part is a leaf (or leaves) or a portion thereof. In a more preferred embodiment, the vegetative plant part is a leaf portion having a surface area of at least 1 cm$^2$.

In an embodiment, the vegetative plant part, the non-human organism or part thereof, or the seed, preferably the vegetative plant part, comprises a first exogenous polynucleotide encoding a WRI1, a second exogenous polynucleotide encoding a DGAT, preferably a DGAT1, a third exogenous polynucleotide encoding an MGAT, preferably an MGAT2, and a fourth exogenous polynucleotide encoding an oleosin, wherein the vegetative plant part, non-human organism or part thereof, or seed has one or more or all of the following features:

i) a total lipid content of at least 8%, at least 10%, at least 12%, at least 14%, or at least 15.5% (% weight), ii) at least a 3 fold, at least a 5 fold, at least a 7 fold, at least an 8 fold, or least a 10 fold, at higher total lipid content in the vegetative plant part or non-human organism relative to a corresponding vegetative plant part or non-human organism lacking the exogenous polynucleotides, iii) a total TAG content of at least 5%, at least 6%, at least 6.5% or at least 7% (% weight of dry weight or seed weight), iv) at least a 40 fold, at least a 50 fold, at least a 60 fold, or at least a 70 fold, or at least a 100 fold, higher total TAG content relative to a corresponding vegetative plant part or non-human organism lacking the exogenous polynucleotides, v) oleic acid comprises at least 15%, at least 19% or at least 22% (% weight) of the fatty acids in TAG, vi) at least a 10 fold, at least a 15 fold or at least a 17 fold higher level of oleic acid in TAG relative to a corresponding vegetative plant part or non-human organism lacking the exogenous polynucleotides, vii) palmitic acid comprises at least 20%, at least 25%, at least 30% or at least 33% (% weight) of the fatty acids in TAG, viii) at least a 1.5 fold higher level of palmitic acid in TAG relative to a corresponding vegetative plant part or non-human organism lacking the exogenous polynucleotides, ix) linoleic acid comprises at least 22%, at least 25%, at least 30% or at least 34% (% weight) of the fatty acids in TAG, x) α-linolenic acid comprises less than 20%, less than 15%, less than 11% or less than 8% (% weight) of the fatty acids in TAG, and xi) at least a 5 fold, or at least an 8 fold, lower level of α-linolenic acid in TAG relative to a corresponding vegetative plant part or non human organism lacking the exogenous polynucleotides. In this embodiment, preferably the vegetative plant part at least has feature(s), i), ii) iii), iv), i) and ii), i) and iii), i) and iv), i) to iii), i), iii) and iv), i) to iv), ii) and iii), ii) and iv), ii) to iv), or iii) and iv). In an embodiment, % dry weight is % leaf dry weight.

In a further embodiment, the vegetative plant part, the non-human organism or part thereof, or the seed, preferably the vegetative plant part, comprises a first exogenous polynucleotide encoding a WRI1, a second exogenous polynucleotide encoding a DGAT, preferably a DGAT1, a third exogenous polynucleotide encoding an oleosin, wherein the vegetative plant part, non-human organism or part thereof, or seed has one or more or all of the following features:

i) a total TAG content of at least 10%, at least 12.5%, at least 15% or at least 17% (% weight of dry weight or seed weight), ii) at least a 40 fold, at least a 50 fold, at least a 60 fold, or at least a 70 fold, or at least a 100 fold, higher total TAG content in the vegetative plant part or non-human organism relative to a corresponding vegetative plant part or non human organism lacking the exogenous polynucleotides, iii) oleic acid comprises at least 19%, at least 22%, or at least 25% (% weight) of the fatty acids in TAG, iv) at least a 10 fold, at least a 15 fold, at least a 17 fold, or at least a 19 fold, higher level of oleic acid in TAG in the vegetative plant part or non-human organism relative to a corresponding vegetative plant part or non-human organism lacking the exogenous polynucleotides, v) palmitic acid comprises at least 20%, at least 25%, or at least 28% (% weight) of the fatty acids in TAG, vi) at least a 1.25 fold higher level of palmitic acid in TAG in the vegetative plant part or non-human organism relative to a corresponding vegetative plant part or non-human organism lacking the exogenous polynucleotides, vii) linoleic acid comprises at least 15%, or at least 20%, (% weight) of the fatty acids in TAG, viii) α-linolenic acid comprises less than 15%, less than 11% or less than 8% (% weight) of the fatty acids in TAG, and ix) at least a 5 fold, or at least an 8 fold, lower level of α-linolenic acid in TAG in the vegetative plant part or non-human organism relative to a corresponding vegetative plant part or non-human organism lacking the exogenous polynucleotides. In this embodiment, preferably the vegetative plant part at least has feature(s), i), ii), or i) and ii). In an embodiment, % dry weight is % leaf dry weight.

Preferably, the defined features for the two above embodiments are as at the flowering stage of the plant.

In an alternate embodiment, the vegetative plant part, the non-human organism or part thereof, or the seed consists of one or more exogenous polynucleotides encoding a DGAT1 and a LEC2.

In a preferred embodiment, the exogenous polynucleotide encoding WRI1 comprises one or more of the following:

i) nucleotides whose sequence is set forth as any one of SEQ ID NOs:231 to 278, ii) nucleotides encoding a polypeptide comprising amino acids whose sequence is set forth as any one of SEQ ID NOs:279 to 337, or a biologically active fragment thereof, iii) nucleotides whose sequence is at least 30% identical to i) or ii), and iv) nucleotides which hybridize to any one of i) to iii) under stringent conditions.

In a preferred embodiment, the exogenous polynucleotide encoding DGAT comprises one or more of the following:

i) nucleotides whose sequence is set forth as any one of SEQ ID NOs:204 to 211, 338 to 346, ii) nucleotides encoding a polypeptide comprising amino acids whose sequence is set forth as any one of SEQ ID NOs:83, 212 to 219, 347 to 355, or a biologically active fragment thereof, iii) nucleotides whose sequence is at least 30% identical to i) or ii), and iv) a polynucleotide which hybridizes to any one of i) to iii) under stringent conditions.

In another preferred embodiment, the exogenous polynucleotide encoding MGAT comprises one or more of the following:

i) nucleotides whose sequence is set forth as any one of SEQ ID NOs:1 to 44, ii) nucleotides encoding a polypeptide comprising amino acids whose sequence is set forth as any one of SEQ ID NOs:45 to 82, or a biologically active fragment thereof, iii) nucleotides whose sequence is at least 30% identical to i) or ii), and iv) a polynucleotide which hybridizes to any one of i) to iii) under stringent conditions.

In another preferred embodiment, the exogenous polynucleotide encoding GPAT comprises one or more of the following:

i) nucleotides whose sequence is set forth as any one of SEQ ID NOs:84 to 143, ii) nucleotides encoding a polypeptide comprising amino acids whose sequence is set forth as any one of SEQ ID NOs:144 to 203, or a biologically active fragment thereof, iii) nucleotides whose sequence is at least 30% identical to i) or ii), and iv) a polynucleotide which hybridizes to any one of i) to iii) under stringent conditions.

In another preferred embodiment, the exogenous polynucleotide encoding DGAT2 comprises one or more of the following:

i) nucleotides whose sequence is set forth as any one of SEQ ID NOs:204 to 211, ii) nucleotides encoding a polypeptide comprising amino acids whose sequence is set forth as any one of SEQ ID NOs:212 to 219, or a biologically active fragment thereof, iii) nucleotides whose sequence is at least 30% identical to i) or ii), and iv) a polynucleotide which hybridizes to any one of i) to iii) under stringent conditions.

In another preferred embodiment, the exogenous polynucleotide encoding an oleosin comprises one or more of the following:

i) nucleotides whose sequence is set forth as any one of SEQ ID NOs:389 to 408, ii) nucleotides encoding a polypeptide comprising amino acids whose sequence is set forth as any one of SEQ ID NOs:362 to 388, or a biologically active fragment thereof, iii) nucleotides whose sequence is at least 30% identical to i) or ii), and iv) a sequence of nucleotides which hybridizes to any one of i) to iii) under stringent conditions.

In an embodiment, the CGi58 polypeptide comprises one or more of the following:

i) nucleotides whose sequence is set forth as any one of SEQ ID NOs:422 to 428, ii) nucleotides encoding a polypeptide comprising amino acids whose sequence is set forth as any one of SEQ ID NOs:429 to 436, or a biologically active fragment thereof, iii) nucleotides whose sequence is at least 30% identical to i) or ii), and iv) a sequence of nucleotides which hybridizes to any one of i) to iii) under stringent conditions.

In another embodiment, the exogenous polynucleotide encoding LEC2 comprises one or more of the following:

i) nucleotides whose sequence is set forth as any one of SEQ ID NOs:437 to 439, ii) nucleotides encoding a polypeptide comprising amino acids whose sequence is set forth as any one of SEQ ID NOs:442 to 444, or a biologically active fragment thereof, iii) nucleotides whose sequence is at least 30% identical to i) or ii), and iv) a sequence of nucleotides which hybridizes to any one of i) to iii) under stringent conditions.

In a further embodiment, the exogenous polynucleotide encoding BBM comprises one or more of the following:

i) nucleotides whose sequence is set forth as any one of SEQ ID NOs:440 or 441 ii) nucleotides encoding a polypeptide comprising amino acids whose sequence is set forth as any one of SEQ ID NOs:445 or 446, or a biologically active fragment thereof, iii) nucleotides whose sequence is at least 30% identical to i) or ii), and iv) a sequence of nucleotides which hybridizes to any one of i) to iii) under stringent conditions.

Clearly, sequences preferred in one embodiment can be combined with sequences preferred in another embodiment and more advantageously further combined with a sequence preferred in yet another embodiment.

In one embodiment, the one or more exogenous polynucleotides encode a mutant MGAT and/or DGAT and/or GPAT. For example, the one or more exogenous polynucleotides may encode a MGAT and/or DGAT and/or GPAT having one, or more than one, conservative amino acid substitutions as exemplified in Table 1 relative to a wildtype MGAT and/or DGAT and/or GPAT as defined by a SEQ ID NO herein. Preferably the mutant polypeptide has an equivalent or greater activity relative to the non-mutant polypeptide.

In an embodiment, the vegetative plant part, non-human organism or part thereof, or seed comprises a first exogenous polynucleotide that encodes a MGAT and a second exogenous polynucleotide that encodes a GPAT. The first and second polynucleotides may be provided as separate molecules or may be provided as a contiguous single molecule, such as on a single T-DNA molecule. In an embodiment, the orientation of transcription of at least one gene on the T-DNA molecule is opposite to the orientation of transcription of at least one other gene on the T-DNA molecule. In a preferred embodiment, the GPAT is a GPAT having phosphatase activity such as an *Arabidopsis* GPAT4 or GPAT6. The GPAT having phosphatase activity acts to catalyze the formation of MAG from G-3-P (i.e., acylates G-3-P to form LPA and subsequently removes a phosphate group to form MAG) in the non-human organism or part thereof. The MGAT then acts to catalyze the formation of DAG in the non-human organism or part thereof by acylating the MAG with an acyl group derived from fatty acyl-CoA. The MGAT such as *A. thaliana*

MGAT1 may also act to catalyze the formation of TAG in the non-human organism or part thereof if it also has DGAT activity.

The vegetative plant part, non-human organism or part thereof, or seed may comprise a third exogenous polynucleotide encoding, for example, a DGAT. The first, second and third polynucleotides may be provided as separate molecules or may be provided as a contiguous single molecule, such as on a single T-DNA molecule. The DGAT acts to catalyse the formation of TAG in the transgenic vegetative plant part, non-human organism or part thereof, or seed by acylating the DAG (preferably produced by the MGAT pathway) with an acyl group derived from fatty acyl-CoA. In an embodiment, the orientation of transcription of at least one gene on the T-DNA molecule is opposite to the orientation of transcription of at least one other gene on the T-DNA molecule.

In another embodiment, the vegetative plant part, non-human organism or part thereof, or seed comprises a first exogenous polynucleotide that encodes a MGAT and a second exogenous polynucleotide that encodes a DGAT. The first and second polynucleotides may be provided as separate molecules or may be provided as a contiguous single molecule, such as on a single T-DNA molecule. In an embodiment, the orientation of transcription of at least one gene on the T-DNA molecule is opposite to the orientation of transcription of at least one other gene on the T-DNA molecule. The vegetative plant part, non-human organism or part thereof, or seed may comprise a third exogenous polynucleotide encoding, for example, a GPAT, preferably a GPAT having phosphatase activity such as an *Arabidopsis* GPAT4 or GPAT6. The first, second and third polynucleotides may be provided as separate molecules or may be provided as a contiguous single molecule.

Furthermore, an endogenous gene activity in the plant, vegetative plant part, or the non-human organism or part thereof, or the seed may be down-regulated. Therefore, in an embodiment, the vegetative plant part, the non-human organism or part thereof, or the seed comprises one or more of:

(i) one or more introduced mutations in a gene which encodes an endogenous enzyme of the plant, vegetative plant part, non-human organism or part thereof, or seed, respectively, or (ii) an exogenous polynucleotide which down-regulates the production and/or activity of an endogenous enzyme of the plant, vegetative plant part, non-human organism or part thereof, or seed, respectively, wherein each endogenous enzyme is selected from the group consisting of a fatty acid acyltransferase such as DGAT, an sn-1 glycerol-3-phosphate acyltransferase (sn-1 GPAT), a 1-acyl-glycerol-3-phosphate acyltransferase (LPAAT), an acyl-CoA:lysophosphatidylcholine acyltransferase (LPCAT), a phosphatidic acid phosphatase (PAP), an enzyme involved in starch biosynthesis such as (ADP)-glucose pyrophosphorylase (AGPase), a fatty acid desaturase such as a Δ12 fatty acid desaturase (FAD2), a polypeptide involved in the degradation of lipid and/or which reduces lipid content such as a lipase such as a CGi58 polypeptide or SUGAR-DEPENDENT1 triacylglycerol lipase, or a combination of two or more thereof. In an embodiment, the exogenous polynucleotide is selected from the group consisting of an antisense polynucleotide, a sense polynucleotide, a catalytic polynucleotide, a microRNA, a polynucleotide which encodes a polypeptide which binds the endogenous enzyme, a double stranded RNA molecule or a processed RNA molecule derived therefrom. In an embodiment, the exogenous polynucleotide which down-regulates the production of AGPase is not the polynucleotide disclosed in Sanjaya et al. (2011). In an embodiment, the exogenous polynucleotides in the vegetative plant part or the non-human organism or part thereof, or seed does not consist of an exogenous polynucleotide encoding a WRI1 and an exogenous polynucleotide encoding an RNA molecule which inhibits expression of a gene encoding an AGPase.

Increasing the level of non-polar lipids is important for applications involving particular fatty acids. Therefore, in an embodiment, the total non-polar lipid, the extracted lipid or oil comprises:

(i) non-polar lipid which is TAG, DAG, TAG and DAG, or MAG, and (ii) a specific PUFA which is EDA, ARA, SDA, ETE, ETA, EPA, DPA, DHA, the specific PUFA being at a level of at least 1% of the total fatty acid content in the non-polar lipid, or a combination of two or more of the specific PUFA, or (iii) a fatty acid which is present at a level of at least 1% of the total fatty acid content in the non-polar lipid and which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains.

In a third aspect, the invention provides non-human organisms, preferably plants, or parts thereof such as vegetative plant parts or seed, which are useful in the processes of the first and second aspects or in further aspects described hereafter. Each of the features in the embodiments described for the first and second aspects can be applied mutatis mutandis to the non-human organisms, preferably plants, or parts thereof such as vegetative plant parts or seed of the third aspect. Particular embodiments are emphasized as follows.

In an embodiment of the third aspect, the present invention provides a non-human organism or a part thereof, wherein the non-human organism or part thereof has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight or seed weight), wherein one or more or all of the following features apply:

(a) the non-human organism or a part thereof comprises one or more exogenous polynucleotide(s) and an increased level of one or more non-polar lipid(s) relative to a corresponding non-human organism or a part thereof, respectively, lacking the one or more exogenous polynucleotide(s), wherein each of the one or more exogenous polynucleotides is operably linked to a promoter which is capable of directing expression of the polynucleotide in a non-human organism or part thereof, (b) the non-human organism is an alga selected from the group consisting of diatoms (bacillariophytes), green algae (chlorophytes), blue-green algae (cyanophytes), golden-brown algae (chrysophytes), haptophytes, brown algae and heterokont algae, (c) the one or more non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, (d) the total fatty acid content in the non-polar lipid(s) comprises at least 2% more oleic acid and/or at least 2% less palmitic acid than the non-polar lipid(s) in the corresponding non-human organism or part thereof lacking the one or more exogenous polynucleotides of part (a), (e) the non-polar lipid(s) comprise a modified level of total sterols, preferably free (non-esterified) sterols, steroyl esters, steroyl glycosides, relative to the non-polar lipid(s) in the corresponding non-human organism or part thereof lacking the one or more exogenous polynucleotides of part (a), (f) the non-polar lipid(s) comprise waxes and/or wax esters, (g) the non-human organism or part thereof is one member of a pooled population or collection of at least about 1000 such non-human organisms or parts thereof, respectively, from which the lipid is extracted.

In an embodiment of the third aspect, the invention provides a plant comprising a vegetative part, or the vegetative part thereof, wherein the vegetative part has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight). In a further preferred embodiment, the total non-polar lipid content is between 5% and 25%, between 7% and 25%, between 10% and 25%, between 12% and 25%, between 15% and 25%, between 7% and 20%, between 10% and 20%, about 10%, about 11%, about 12%, about 13%, about 14%, about 15%, about 16%, about 17%, about 18%, about 20%, or about 22%, each as a percentage of dry weight. In a particularly preferred embodiment, the vegetative plant part is a leaf (or leaves) or a portion thereof. In a more preferred embodiment, the vegetative plant part is a leaf portion having a surface area of at least 1 cm². In a further embodiment, the non-polar lipid comprises at least 90% triacylglycerols (TAG). Preferably the plant is fertile, morphologically normal, and/or agronomically useful. Seed of the plant preferably germinates at a rate substantially the same as for a corresponding wild-type plant. Preferably the vegetative part is a leaf or a stem, or a combination of the two, or a root or tuber such as, for example, potato tubers.

In another embodiment, the non-human organism, preferably plant, or part thereof such as vegetative plant part or seed comprises one or more exogenous polynucleotides as defined herein and has an increased level of the one or more non-polar lipids and/or the total non-polar lipid content which is at least 2-fold, at least 3-fold, at least 4-fold, at least 5-fold, at least 6-fold, at least 7-fold, at least 8-fold, at least 9-fold, at least 10-fold, or at least 12-fold, preferably at least about 13-fold or at least about 15-fold greater on a relative basis than a corresponding non-human organism, preferably plant, or part thereof such as vegetative plant part or seed lacking the one or more exogenous polynucleotides.

In an embodiment, the invention provides a canola plant comprising canola seed whose oil content is at least 45% on a weight basis. Preferably, the canola plant or its seed have features as described in the first and second aspects of the invention.

In an embodiment, the invention provides a corn plant comprising corn seed whose oil content is at least 5% on a weight basis. Preferably, the corn plant or its seed have features as described in the first and second aspects of the invention.

In an embodiment, the invention provides a soybean plant comprising soybean seed whose oil content is at least 20% on a weight basis. Preferably, the soybean plant or its seed have features as described in the first and second aspects of the invention.

In an embodiment, the invention provides a lupin plant comprising lupin seed whose oil content is at least 10% on a weight basis. Preferably, the lupin plant or its seed have features as described in the first and second aspects of the invention.

In an embodiment, the invention provides a peanut plant comprising peanuts whose oil content is at least 50% on a weight basis. Preferably, the peanut plant or its seed have features as described in the first and second aspects of the invention.

In an embodiment, the invention provides a sunflower plant comprising sunflower seed whose oil content is at least 50% on a weight basis. Preferably, the sunflower plant or its seed have features as described in the first and second aspects of the invention.

In an embodiment, the invention provides a cotton plant comprising cotton seed whose oil content is at least 41% on a weight basis. Preferably, the cotton plant or its seed have features as described in the first and second aspects of the invention.

In an embodiment, the invention provides a safflower plant comprising safflower seed whose oil content is at least 35% on a weight basis. Preferably, the safflower plant or its seed have features as described in the first and second aspects of the invention.

In an embodiment, the invention provides a flax plant comprising flax seed whose oil content is at least 36% on a weight basis. Preferably, the flax plant or its seed have features as described in the first and second aspects of the invention.

In an embodiment, the invention provides a *Camelina sativa* plant comprising *Camelina sativa* seed whose oil content is at least 36% on a weight basis. Preferably, the *Camelina sativa* plant or its seed have features as described in the first and second aspects of the invention.

In embodiments, the plants may be further defined by Features (i), (ii) and (iii) as described hereinbefore. In a preferred embodiment, the plant or the vegetative part comprises one or more or all of the following features:

(i) oleic acid in a vegetative part or seed of the plant, the oleic acid being in an esterified or non-esterified form, wherein at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acids in the lipid content of the vegetative part or seed is oleic acid, (ii) oleic acid in a vegetative part or seed of the plant, the oleic acid being in an esterified form in non-polar lipid, wherein at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acids in the non-polar lipid content of the vegetative part or seed is oleic acid, (iii) a modified fatty acid in a vegetative part or seed of the plant, the modified fatty acid being in an esterified or non-esterified form, preferably in an esterified form in non-polar lipids of the vegetative part or seed, wherein the modified fatty acid comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, and (iv) waxes and/or wax esters in the non-polar lipid of the vegetative part or seed of the plant.

In an embodiment, the plant or the vegetative plant part is a member of a population or collection of at least about 1000 such plants or parts. That is, each plant or plant part in the population or collection has essentially the same properties or comprise the same exogenous nucleic acids as the other members of the population or collection. Preferably, the plants are homozygous for the exogenous polynucleotides, which provides a degree of uniformity. Preferably, the plants are growing in a field. The collection of vegetative plants parts have preferably been harvested from plants growing in a field. Preferably, the vegetative plant parts have been harvested at a time when the yield of non-polar lipids are at their highest. In one embodiment, the vegetative plant parts have been harvested about at the time of flowering. In another embodiment, the vegetative plant parts are harvested when the plants are at least about 1 month of age. In another embodiment, the vegetative plant parts are harvested from about at the time of flowering to about the beginning of senescence. In another embodiment, the vegetative plant parts are harvested at least about 1 month after induction of expression of inducible genes.

In a further embodiment of the third aspect, the invention provides a vegetative plant part, non-human organism or a part thereof, or seed comprising one or more exogenous polynucleotide(s) and an increased level of one or more non-polar lipid(s) relative to a corresponding vegetative plant part, non-human organism or a part thereof, or seed lacking the one or more exogenous polynucleotide(s), wherein each of the one or more exogenous polynucleotides is operably linked to a promoter which is capable of directing expression of the polynucleotide in a vegetative plant part, non-human organism or part thereof, or seed and wherein one or more or all of the following features apply:

(i) the one or more exogenous polynucleotide(s) comprise a first exogenous polynucleotide which encodes an RNA or transcription factor polypeptide that increases the expression of one or more glycolytic or fatty acid biosynthetic genes in a vegetative plant part, non-human organism or a part thereof, or seed and a second exogenous polynucleotide which encodes an RNA or polypeptide involved in biosynthesis of one or more non-polar lipids, (ii) if the non-human organism is a plant, a vegetative part of the plant has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight), (iii) the non-human organism is an alga selected from the group consisting of diatoms (bacillariophytes), green algae (chlorophytes), blue-green algae (cyanophytes), golden-brown algae (chrysophytes), haptophytes, brown algae and heterokont algae, (iv) the non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, (v) the vegetative plant part, non-human organism or part thereof, or seed comprises oleic acid in an esterified or non-esterified form in its lipid, wherein at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acids in the lipid of the vegetative plant part, non-human organism or part thereof, or seed is oleic acid, (vi) the vegetative plant part, non-human organism or part thereof, or seed comprises oleic acid in an esterified form in its non-polar lipid, wherein at least 20% (mol %), at least 22% (mol %), at least 30% (mol %), at least 40% (mol %), at least 50% (mol %), or at least 60% (mol %), preferably at least 65% (mol %) or at least 66% (mol %) of the total fatty acids in the non-polar lipid of the vegetative plant part, non-human organism or part thereof, or seed is oleic acid, (vii) the total fatty acid content in the lipid of the vegetative plant part, non-human organism or part thereof, or seed comprises at least 2% more oleic acid and/or at least 2% less palmitic acid than the lipid in the corresponding vegetative plant part, non-human organism or part thereof, or seed lacking the one or more exogenous polynucleotides, and/or (viii) the total fatty acid content in the non-polar lipid of the vegetative plant part, non-human organism or part thereof, or seed comprises at least 2% more oleic acid and/or at least 2% less palmitic acid than the non-polar lipid in the corresponding vegetative plant part, non-human organism or part thereof, or seed lacking the one or more exogenous polynucleotides, (ix) the non-polar lipid(s) comprise a modified level of total sterols, preferably free sterols, steroyl esters and/or steroyl glycosides, (x) the non-polar lipid(s) comprise waxes and/or wax esters, and (xi) the non-human organism or part thereof is one member of a population or collection of at least about 1000 such non-human organisms or parts thereof.

In an embodiment, the one or more exogenous polynucleotide(s) comprise the first exogenous polynucleotide and the second exogenous polynucleotide, and wherein one or more or all of the features (ii) to (xi) apply.

In an embodiment of (ii) above, the total non-polar lipid content is between 5% and 25%, between 7% and 25%, between 10% and 25%, between 12% and 25%, between 15% and 25%, between 7% and 20%, between 10% and 20%, about 10%, about 11%, about 12%, about 13%, about 14%, about 15%, about 16%, about 17%, about 18%, about 20%, or about 22%, each as a percentage of dry weight. In a more preferred embodiment, the vegetative plant part is a leaf portion having a surface area of at least 1 $cm^2$.

In preferred embodiments, the non-human organism or part thereof is a plant, an alga or an organism suitable for fermentation such as a fungus. The part of the non-human organism may be a seed, fruit, or a vegetative part of a plant such as an aerial plant part or a green part such as a leaf or stem. In another embodiment, the part is a cell of a multicellular organism. With respect to the part of the non-human organism, the part comprises at least one cell of the non-human organism. In further preferred embodiments, the non-human organism or part thereof is further defined by features as defined in any of the embodiments described in the first and second aspects of the invention, including but not limited to Features (i), (ii) and (iii), and the exogenous polynucleotides or combinations of exogenous polynucleotides as defined in any of the embodiments described in the first and second aspects of the invention.

In an embodiment, the plant, vegetative plant part, non-human organism or part thereof, or seed comprises one or more exogenous polynucleotides which encode:
  i) a Wrinkled 1 (WRI1) transcription factor and a DGAT,
  ii) a WRI1 transcription factor and a DGAT and an Oleosin,
  iii) a WRI1 transcription factor, a DGAT, a MGAT and an Oleosin,
  iv) a monoacylglycerol acyltransferase (MGAT),
  v) a diacylglycerol acyltransferase 2 (DGAT2), vi) a MGAT and a glycerol-3-phosphate acyltransferase (GPAT),
vii) a MGAT and a DGAT,
viii) a MGAT, a GPAT and a DGAT,
ix) a WRI1 transcription factor and a MGAT,
x) a WRI1 transcription factor, a DGAT and a MGAT,
xi) a WRI1 transcription factor, a DGAT, a MGAT, an Oleosin and a GPAT,
xii) a DGAT and an Oleosin, or
xiii) a MGAT and an Oleosin, and
xiv) optionally, a silencing suppressor polypeptide,
wherein each exogenous polynucleotide is operably linked to a promoter which is capable of directing expression of the polynucleotide in a plant, vegetative plant part, non-human organism or part thereof, or seed, respectively. The one or more exogenous polynucleotides may comprise nucleotides whose sequence is defined herein. Preferably, the plant, vegetative plant part, non-human organism or part thereof, or seed is homozygous for the one or more exogenous polynucleotides. Preferably, the exogenous polynucleotides are integrated into the genome of the plant, vegetative plant part, non-human organism or part thereof, or seed. The one or more polynucleotides may be provided as separate molecules or may be provided as a contiguous single molecule. Preferably, the exogenous polynucleotides are integrated in the genome of the plant or organism at a single genetic locus or genetically linked loci, more preferably in the homozygous state. More preferably, the integrated exogenous polynucleotides are genetically linked with a selectable marker gene such as an herbicide tolerance gene.

In a preferred embodiment, the vegetative plant part, the non-human organism or part thereof, or the seed comprises a first exogenous polynucleotide encoding a WRI1 and a second exogenous polynucleotide encoding a DGAT, preferably a DGAT1.

In another preferred embodiment, the vegetative plant part, the non-human organism or part thereof, or the seed comprises a first exogenous polynucleotide encoding a WRI1, a second exogenous polynucleotide encoding a DGAT, preferably a DGAT1, and a third exogenous polynucleotide encoding an oleosin.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an MGAT, preferably an MGAT2, and a fifth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an RNA molecule which inhibits expression of a gene encoding a lipase such as a CGi58 polypeptide.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding LEC2 or BBM.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding an MGAT, preferably an MGAT2.

In a further embodiment, the vegetative plant part, the non-human organism or part thereof, or the seed comprises a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, a fifth exogenous polynucleotide encoding an MGAT, preferably an MGAT2, and a sixth exogenous polynucleotide encoding LEC2 or BBM.

In an embodiment, the seed comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2. Preferably, the seed further comprises a fifth exogenous polynucleotide encoding a GPAT.

Where relevant, instead of a polynucleotide encoding an RNA molecule which inhibits expression of a gene encoding a lipase such as a CGi58 polypeptide, the vegetative plant part, the non-human organism or part thereof, or the seed has one or more introduced mutations in the lipase gene such as a CGi58 gene which confers reduced levels of the lipase polypeptide when compared to an isogenic vegetative plant part, non-human organism or part thereof, or seed lacking the mutation.

In a preferred embodiment, the exogenous polynucleotides encoding the DGAT and oleosin are operably linked to a constitutive promoter, or a promoter active in green tissues of a plant at least before and up until flowering, which is capable of directing expression of the polynucleotides in the vegetative plant part, the non-human organism or part thereof, or the seed. In a further preferred embodiment, the exogenous polynucleotide encoding WRI1, and RNA molecule which inhibits expression of a gene encoding a lipase such as a CGi58 polypeptide, is operably linked to a constitutive promoter, a promoter active in green tissues of a plant at least before and up until flowering, or an inducible promoter, which is capable of directing expression of the polynucleotides in the vegetative plant part, the non-human organism or part thereof, or the seed. In yet a further preferred embodiment, the exogenous polynucleotides encoding LEC2, BBM and/or MGAT2 are operably linked to an inducible promoter which is capable of directing expression of the polynucleotides in the vegetative plant part, the non-human organism or part thereof, or the seed.

In each of the above embodiments, the total non-polar lipid content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w dry weight or seed weight). In a further preferred embodiment, the total non-polar lipid content is between 5% and 25%, between 7% and 25%, between 10% and 25%, between 12% and 25%, between 15% and 25%, between 7% and 20%, between 10% and 20%, between 10% and 15%, between 15% and 20%, between 20% and 25%, about 10%, about 11%, about 12%, about 13%, about 14%, about 15%, about 16%, about 17%, about 18%, about 20%, or about 22%, each as a percentage of dry weight or seed weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total TAG content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, or more preferably at least about 17% (w/w dry weight or seed weight). In a further preferred embodiment, the total TAG content is between 5% and 30%, between 7% and 30%, between 10% and 30%, between 12% and 30%, between 15% and 30%, between 7% and 30%, between 10% and 30%, between 20% and 28%, between 18% and 25%, between 22% and 30%, about 10%, about 11%, about 12%, about 13%, about 14%, about 15%, about 16%, about 17%, about 18%, about 20%, or about 22%, each as a percentage of dry weight or seed weight. In a particularly preferred embodiment, the vegetative plant part is a leaf (or leaves) or a portion thereof. In a more preferred embodiment, the vegetative plant part is a leaf portion having a surface area of at least 1 cm$^2$.

Furthermore, in each of the above embodiments, the total lipid content of the vegetative plant part, or non-human organism or part thereof, or the seed, preferably a plant leaf or part thereof, stem or tuber, is at least about 3%, more preferably at least about 5%, preferably at least about 7%, more preferably at least about 10%, more preferably at least about 11%, more preferably at least about 12%, more preferably at least about 13%, more preferably at least about 14%, more preferably at least about 15%, more preferably at least about 17% (w/w dry weight or seed weight), more preferably at least about 20%, more preferably at least about 25%. In a further preferred embodiment, the total lipid content is between 5% and 35%, between 7% and 35%, between 10% and 35%, between 12% and 35%, between 15% and 35%, between 7% and 35%, between 10% and 20%, between 18% and 28%, between 20% and 28%, between 22% and 28%, about 10%, about 11%, about 12%, about 13%, about 14%, about 15%, about 16%, about 17%, about 18%, about 20%, about 22%, or about 25%, each as a percentage of dry weight or seed weight. Typically, the total lipid content of the vegetative plant part, or non-human organism or part thereof is about 2-3% higher than the non-polar lipid content. In a particularly preferred embodiment, the vegetative plant part is a leaf (or leaves) or a portion thereof. In a more preferred embodiment, the vegetative plant part is a leaf portion having a surface area of at least 1 cm$^2$.

In an embodiment, the vegetative plant part, the non-human organism or part thereof, or the seed, preferably the vegetative plant part, comprises a first exogenous polynucleotide encoding a WRI1, a second exogenous polynucleotide encoding a DGAT, preferably a DGAT1, a third exogenous polynucleotide encoding an MGAT, preferably an MGAT2, and a fourth exogenous polynucleotide encoding an oleosin, wherein the vegetative plant part, non-human organism or part thereof, or seed has one or more or all of the following features:

i) a total lipid content of at least 8%, at least 10%, at least 12%, at least 14%, or at least 15.5% (% weight of dry weight or seed weight), ii) at least a 3 fold, at least a 5 fold, at least a 7 fold, at least an 8 fold, or least a 10 fold, at higher total lipid content in the vegetative plant part or non-human organism relative to a corresponding vegetative plant part or non-human organism lacking the exogenous polynucleotides, iii) a total TAG content of at least 5%, at least 6%, at least 6.5% or at least 7% (% weight of dry weight or seed weight), iv) at least a 40 fold, at least a 50 fold, at least a 60 fold, or at least a 70 fold, or at least a 100 fold, higher total TAG content relative to a corresponding vegetative plant part or non-human organism lacking the exogenous polynucleotides, v) oleic acid comprises at least 15%, at least 19% or at least 22% (% weight) of the fatty acids in TAG, vi) at least a 10 fold, at least a 15 fold or at least a 17 fold higher level of oleic acid in TAG relative to a corresponding vegetative plant part or non-human organism lacking the exogenous polynucleotides, vii) palmitic acid comprises at least 20%, at least 25%, at least 30% or at least 33% (% weight) of the fatty acids in TAG, viii) at least a 1.5 fold higher level of palmitic acid in TAG relative to a corresponding vegetative plant part on non-human organism lacking the exogenous polynucleotides, ix) linoleic acid comprises at least 22%, at least 25%, at least 30% or at least 34% (% weight) of the fatty acids in TAG, x) α-linolenic acid comprises less than 20%, less than 15%, less than 11% or less than 8% (% weight) of the fatty acids in TAG, and xi) at least a 5 fold, or at least an 8 fold, lower level of α-linolenic acid in TAG relative to a corresponding vegetative plant part or non-human organism lacking the exogenous polynucleotides. In this embodiment, preferably the vegetative plant part at least has feature(s), i), ii) iii), iv), i) and ii), i) and iii), i) and iv), i) to iii), i), iii) and iv), i) to iv), ii) and iii), ii) and iv), ii) to iv), or iii) and iv). In an embodiment, % dry weight is % leaf dry weight.

In a further embodiment, the vegetative plant part, the non-human organism or part thereof, or the seed, preferably the vegetative plant part, comprises a first exogenous polynucleotide encoding a WRI1, a second exogenous polynucleotide encoding a DGAT, preferably a DGAT1, a third exogenous polynucleotide encoding an oleosin, wherein the vegetative plant part, non-human organism or part thereof, or seed has one or more or all of the following features:

i) a total TAG content of at least 10%, at least 12.5%, at least 15% or at least 17% (% weight of dry weight or seed weight), ii) least a 40 fold, at least a 50 fold, at least a 60 fold, or at least a 70 fold, or at least a 100 fold, higher total TAG content in the vegetative plant part or non-human organism relative to a corresponding vegetative plant part or non-human organism lacking the exogenous polynucleotides, iii) oleic acid comprises at least 19%, at least 22%, or at least 25% (% weight) of the fatty acids in TAG, iv) at least a 10 fold, at least a 15 fold, at least a 17 fold, or at least a 19 fold, higher level of oleic acid in TAG in the vegetative plant part or non-human organism relative to a corresponding vegetative plant part or non-human organism lacking the exogenous polynucleotides, v) palmitic acid comprises at least 20%, at least 25%, or at least 28% (% weight) of the fatty acids in TAG, vi) at least a 1.25 fold higher level of palmitic acid in TAG in the vegetative plant part or non-human organism relative to a corresponding vegetative plant part or non-human organism lacking the exogenous polynucleotides, vii) linoleic acid comprises at least 15%, or at least 20%, (% weight) of the fatty acids in TAG, viii) α-linolenic acid comprises less than 15%, less than 11% or less than 8% (% weight) of the fatty acids in TAG, and ix) at least a 5 fold, or at least an 8 fold, lower level of α-linolenic acid in TAG in the vegetative plant part or non-human organism relative to a corresponding vegetative plant part or non-human organism lacking the exogenous polynucleotides. In this embodiment, preferably the vegetative plant part at least has feature(s), i), ii), or i) and ii). In an embodiment, % dry weight is % leaf dry weight.

Preferably, the defined features for the two above embodiments are as at the flowering stage of the plant.

In a fourth aspect, the invention provides a plant seed capable of growing into a plant of the invention, or obtained from a plant of the invention, for example a non-human organism of the invention which is a plant. In an embodiment, the seed comprises one or more exogenous polynucleotides as defined herein.

In a fifth aspect, the invention provides a process for obtaining a cell with enhanced ability to produce one or more non-polar lipids, the process comprising the steps of:
  a) introducing into a cell one or more exogenous polynucleotides,
  b) expressing the one or more exogenous polynucleotides in the cell or a progeny cell thereof,
  c) analysing the lipid content of the cell or progeny cell, and
  d) selecting a cell or progeny cell having an increased level of one or more non-polar lipids relative to a corresponding cell or progeny cell lacking the exogenous polynucleotides,
wherein the one or more exogenous polynucleotides encode
  i) a Wrinkled 1 (WRI1) transcription factor and a DGAT,
  ii) a WRI1 transcription factor and a DGAT and an Oleosin,
  iii) a WRI1 transcription factor, a DGAT, a MGAT and an Oleosin,
  iv) a monoacylglycerol acyltransferase (MGAT),
  v) a diacylglycerol acyltransferase 2 (DGAT2),
  vi) a MGAT and a glycerol-3-phosphate acyltransferase (GPAT),
  vii) a MGAT and a DGAT,
  viii) a MGAT, a GPAT and a DGAT,
  ix) a WRI1 transcription factor and a MGAT,
  x) a WRI1 transcription factor, a DGAT and a MGAT,
  xi) a WRI1 transcription factor, a DGAT, a MGAT, an Oleosin and a GPAT,
  xii) a DGAT and an Oleosin, or
  xiii) a MGAT and an Oleosin, and
  xiv) optionally, a silencing suppressor polypeptide,
wherein each exogenous polynucleotide is operably linked to a promoter that is capable of directing expression of the exogenous polynucleotide in the cell or progeny cell.

In an embodiment, the selected cell or progeny cell comprises:
  i) a first exogenous polynucleotide encoding a WRI1 and a second exogenous polynucleotide encoding a DGAT, preferably a DGAT1,
  ii) a first exogenous polynucleotide encoding a WRI1, a second exogenous polynucleotide encoding a DGAT, preferably a DGAT1, and a third exogenous polynucleotide encoding an oleosin,
  iii) a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2,
  iv) a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding LEC2 or BBM,
  v) a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an MGAT, preferably an MGAT2, and a fifth exogenous polynucleotide encoding LEC2 or BBM,
  vi) a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an RNA molecule which inhibits expression of a gene encoding a lipase such as a CGi58 polypeptide,
  vii) a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding LEC2 or BBM,
  viii) a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, and a fifth exogenous polynucleotide encoding an MGAT, preferably an MGAT2, or
  ix) a first exogenous polynucleotide encoding a WRI1, a second exogenous polynucleotide encoding a DGAT, preferably a DGAT1, a third exogenous polynucleotide encoding an oleosin, a fourth exogenous polynucleotide encoding an RNA molecule which inhibits expression of a gene encoding a lipase such as a CGi58 polypeptide, a fifth exogenous polynucleotide encoding an MGAT, preferably an MGAT2, and a sixth exogenous polynucleotide encoding LEC2 or BBM.

In a further embodiment, the selected cell or progeny cell is a cell of a plant seed and comprises a first exogenous polynucleotide encoding a WRI1, a second exogenous polynucleotide encoding a DGAT, preferably a DGAT1, a third exogenous polynucleotide encoding an oleosin, and a fourth exogenous polynucleotide encoding an MGAT, preferably an MGAT2. Preferably, the seed further comprises a fifth exogenous polynucleotide encoding a GPAT.

In a preferred embodiment, the one or more exogenous polynucleotides are stably integrated into the genome of the cell or progeny cell.

In a preferred embodiment, the process further comprises a step of regenerating a transgenic plant from the cell or progeny cell comprising the one or more exogenous polynucleotides. The step of regenerating a transgenic plant may be performed prior to the step of expressing the one or more exogenous polynucleotides in the cell or a progeny cell thereof, and/or prior to the step of analysing the lipid content of the cell or progeny cell, and/or prior to the step of selecting the cell or progeny cell having an increased level of one or more non-polar lipids. The process may further comprise a step of obtaining seed or a progeny plant from the transgenic plant, wherein the seed or progeny plant comprises the one or more exogenous polynucleotides.

The process of the fifth aspect may be used as a screening assay to determine whether a polypeptide encoded by an exogenous polynucleotide has a desired function. The one or more exogenous polynucleotides in this aspect may comprise a sequence as defined above. Further, the one or more exogenous polynucleotides may not be known prior to the process to encode a WRI1 transcription factor and a DGAT, a WRI1 transcription factor and a MGAT, a WRI1 transcription factor, a DGAT and a MGAT, a WRI1 transcription factor, a DGAT, a MGAT and an Oleosin, a WRI1 transcription factor, a DGAT, a MGAT, an Oleosin and a GPAT, a WRI1 transcription factor, a DGAT and an oleosin, a DGAT and an Oleosin, or a MGAT and an Oleosin, but rather may be candidates therefor. The process therefore may be used as an assay to identify or select polynucleotides encoding a WRI1 transcription factor and a DGAT, a WRI1 transcription factor and a MGAT, a WRI1 transcription factor, a DGAT and a MGAT, a WRI1 transcription factor, a DGAT, a MGAT and an Oleosin, a WRI1 transcription factor, a DGAT, a MGAT, an Oleosin and a GPAT, a WRI1 transcription factor, a DGAT and an oleosin, a DGAT and an Oleosin, or a MGAT and an Oleosin. The candidate polynucleotides are introduced into a cell and the products analysed to determine whether the candidates have the desired function.

In a sixth aspect, the invention provides a transgenic cell or transgenic plant obtained using a process of the invention, or a vegetative plant part or seed obtained therefrom which comprises the one or more exogenous polynucleotides.

In a seventh aspect, the invention provides a use of one or more polynucleotides encoding, or a genetic construct comprising polynucleotides encoding:
  i) a Wrinkled 1 (WRI1) transcription factor and a DGAT,
  ii) a WRI1 transcription factor and a DGAT and an Oleosin,
  iii) a WRI1 transcription factor, a DGAT, a MGAT and an Oleosin,
  iv) a monoacylglycerol acyltransferase (MGAT),
  v) a diacylglycerol acyltransferase 2 (DGAT2),
  vi) a MGAT and a glycerol-3-phosphate acyltransferase (GPAT),
  vii) a MGAT and a DGAT,
  viii) a MGAT, a GPAT and a DGAT,
  ix) a WRI1 transcription factor and a MGAT,
  x) a WRI1 transcription factor, a DGAT and a MGAT,
  xi) a WRI1 transcription factor, a DGAT, a MGAT, an Oleosin and a GPAT,
  xii) a DGAT and an Oleosin, or
  xiii) a MGAT and an Oleosin, and
  xiv) optionally, a silencing suppressor polypeptide,
for producing a transgenic cell, a transgenic non-human organism or a part thereof or a transgenic seed having an enhanced ability to produce one or more non-polar lipids relative to a corresponding cell, non-human organism or part thereof, or seed lacking the one or more polynucleotides, wherein each of the one or more polynucleotides is exogenous to the cell, non-human organism or part thereof, or seed and is operably linked to a promoter which is capable of directing expression of the polynucleotide in a cell, a non-human organism or a part thereof or a seed, respectively.

In an embodiment, the invention provides a use of a first polynucleotide encoding an RNA or transcription factor polypeptide that increases the expression of one or more glycolytic or fatty acid biosynthetic genes in a cell, a non-human organism or a part thereof, or a seed, together with a second polynucleotide that encodes an RNA or polypeptide involved in biosynthesis of one or more non-polar lipids, for producing a transgenic cell, a transgenic non-human organism or part thereof, or a transgenic seed having an enhanced ability to produce one or more non-polar lipids relative to a corresponding cell, non-human organism or part thereof, or seed lacking the first and second polynucleotides, wherein the first and second polynucleotides are each exogenous to the cell, non-human organism or part thereof, or seed and are each operably linked to a promoter which is capable of directing expression of the polynucleotide in the transgenic cell, transgenic non-human organism or part thereof, or transgenic seed, respectively.

In a further embodiment, the invention provides a use of one or more polynucleotides for producing a transgenic cell, a transgenic non-human organism or part thereof, or a transgenic seed having an enhanced ability to produce one or more non-polar lipid(s) relative to a corresponding cell, non-human organism or part thereof, or seed lacking the one or more exogenous polynucleotides, wherein each of the one or more polynucleotides is exogenous to the cell, non-human organism or part thereof, or seed and is operably linked to a promoter which is capable of directing expression of the polynucleotide in a cell, a non-human organism or a part thereof, or a seed, respectively, and wherein the non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains. Such uses also have utility as screening assays.

In an eighth aspect, the invention provides a process for producing seed, the process comprising:
  i) growing a plant, multiple plants, or non-human organism according to the invention, and
  ii) harvesting seed from the plant, plants, or non-human organism.
In a preferred embodiment, the process comprises growing a population of at least about 1000 such plants in a field, and harvesting seed from the population of plants. The harvested seed may be placed in a container and transported away from the field, for example exported out of the country, or stored prior to use.

In a ninth aspect, the invention provides a fermentation process comprising the steps of:
  i) providing a vessel containing a liquid composition comprising a non-human organism of the invention which is suitable for fermentation, and constituents required for fermentation and fatty acid biosynthesis, and
  ii) providing conditions conducive to the fermentation of the liquid composition contained in said vessel.

In a tenth aspect, the invention provides a recovered or extracted lipid obtainable by a process of the invention, or obtainable from a vegetative plant part, non-human organism or part thereof, cell or progeny cell, transgenic plant, or seed of the invention. The recovered or extracted lipid, preferably oil such as seedoil, may have an enhanced TAG content, DAG content, TAG and DAG content, MAG content, PUFA content, specific PUFA content, or a specific fatty acid content, and/or total non-polar lipid content. In a preferred embodiment, the MAG is 2-MAG. The extent of the increased TAG content, DAG content, TAG and DAG content, MAG content, PUFA content, specific PUFA content, specific fatty acid content and/or total non-polar lipid content may be as defined in Feature (i).

In an eleventh aspect, the invention provides an industrial product produced by a process of the invention, preferably which is a hydrocarbon product such as fatty acid esters, preferably fatty acid methyl esters and/or a fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar.

In a twelfth aspect, the invention provides a use of a plant, vegetative plant part, non-human organism or a part thereof, cell or progeny cell, transgenic plant produced by a process of the invention, or a seed or a recovered or extracted lipid of the invention for the manufacture of an industrial product. The industrial product may be as defined above.

In a thirteenth aspect, the invention provides a process for producing fuel, the process comprising:
   i) reacting a lipid of the invention with an alcohol, optionally in the presence of a catalyst, to produce alkyl esters, and
   ii) optionally, blending the alkyl esters with petroleum based fuel. The alkyl esters are preferably methyl esters. The fuel produced by the process may comprise a minimum level of the lipid of the invention or a hydrocarbon product produced therefrom such as at least 10%, at least 20%, or at least 30% by volume.

In a fourteenth aspect, the invention provides a process for producing a synthetic diesel fuel, the process comprising:
   i) converting lipid in a vegetative plant, non-human organism or part thereof of the invention to a syngas by gasification, and
   ii) converting the syngas to a biofuel using a metal catalyst or a microbial catalyst.

In a fifteenth aspect, the invention provides a process for producing a biofuel, the process comprising converting lipid in a vegetative plant part, non-human organism or part thereof of the invention to bio-oil by pyrolysis, a bioalcohol by fermentation, or a biogas by gasification or anaerobic digestion.

In a sixteenth aspect, the invention provides a process for producing a feedstuff, the process comprising admixing a plant, vegetative plant part thereof, non-human organism or part thereof, cell or progeny cell, transgenic plant produced by a process of the invention, seed, recovered or extracted lipid, or an extract or portion thereof, with at least one other food ingredient.

In a seventeenth aspect, the invention provides feedstuffs, cosmetics or chemicals comprising a plant, vegetative part thereof, non-human organism or part thereof, cell or progeny cell, transgenic plant produced by a process of the invention, seed, or a recovered or extracted lipid of the invention, or an extract or portion thereof.

Naturally, when vegetative material of a plant is to be harvested because of its oil content it is desirable to harvest the material when lipid levels are as high as possible. The present inventors have noted an association between the glossiness of the vegetative tissue of the plants of the invention and oil content, with high levels of lipid being associated with high gloss. Thus, the glossiness of the vegetative material can be used as marker to assist in determining when to harvest the material.

In a further aspect, the invention provides a recombinant cell comprising one or more exogenous polynucleotide(s) and an increased level of one or more non-polar lipid(s) relative to a corresponding cell lacking the one or more exogenous polynucleotide(s), wherein each of the one or more exogenous polynucleotides is operably linked to a promoter which is capable of directing expression of the polynucleotide in a cell, and wherein one or more or all of the following features apply:

(a) the one or more exogenous polynucleotide(s) comprise a first exogenous polynucleotide which encodes an RNA or transcription factor polypeptide that increases the expression of one or more glycolytic or fatty acid biosynthetic genes in a non-human organism or a part thereof, and a second exogenous polynucleotide which encodes an RNA or polypeptide involved in biosynthesis of one or more non-polar lipids, (b) if the cell is a cell of a vegetative part of a plant, the cell has a total non-polar lipid content of at least about 3%, more preferably at least about 5%, preferably at least about 7%, more preferably at least about 10%, more preferably at least about 11%, more preferably at least about 12%, more preferably at least about 13%, more preferably at least about 14%, or more preferably at least about 15% (w/w), (c) the cell is an alga selected from the group consisting of diatoms (bacillariophytes), green algae (chlorophytes), blue-green algae (cyanophytes), golden-brown algae (chrysophytes), haptophytes, brown algae and heterokont algae, (d) the one or more non-polar lipid(s) comprise a fatty acid which comprises a hydroxyl group, an epoxy group, a cyclopropane group, a double carbon-carbon bond, a triple carbon-carbon bond, conjugated double bonds, a branched chain such as a methylated or hydroxylated branched chain, or a combination of two or more thereof, or any of two, three, four, five or six of the aforementioned groups, bonds or branched chains, (e) the total fatty acid content in the non-polar lipid(s) comprises at least 2% more oleic acid and/or at least 2% less palmitic acid than the non-polar lipid(s) in the corresponding cell lacking the one or more exogenous polynucleotides, (f) the non-polar lipid(s) comprise a modified level of total sterols, preferably free (non-esterified) sterols, steroyl esters, steroyl glycosides, relative to the non-polar lipid(s) in the corresponding cell lacking the one or more exogenous polynucleotides, (g) the non-polar lipid(s) comprise waxes and/or wax esters, and (h) the cell is one member of a population or collection of at least about 1000 such cells.

In an embodiment, the one or more exogenous polynucleotide(s) comprise the first exogenous polynucleotide and the second exogenous polynucleotide, and wherein one or more or all of the features (b) to (h) apply.

In a further aspect, the present invention provides a method of determining when to harvest a plant to optimize the amount of lipid in the vegetative tissue of the plant at harvest, the method comprising
   i) measuring the gloss of the vegetative tissue,
   ii) comparing the measurement with a pre-determined minimum glossiness level, and
   iii) optionally harvesting the plant.

In another aspect, the present invention provides a method of predicting the quantity of lipid in vegetative tissue of a plant, the method comprising measuring the gloss of the vegetative tissue.

In a preferred embodiment of the two above aspects the vegetative tissue is a leaf (leaves) or a portion thereof.

In a further aspect, the present invention provides a method of trading a plant or a part thereof, comprising obtaining the plant or part comprising a cell of the invention, and trading the obtained plant or plant part for pecuniary gain.

In an embodiment, the method further comprises one or more or all of:
  i) cultivating the plant,
  ii) harvesting the plant part from the plant,
  iii) storing the plant or part thereof, or
  iv) transporting the plant or part thereof to a different location.

In a further aspect, the present invention provides a process for producing bins of plant parts comprising:
  a) harvesting plant parts comprising a cell of the invention by collecting the plant parts from the plants, or by separating the plant parts from other parts of the plants,
  b) optionally, sifting and/or sorting the harvested plant parts, and
  c) loading the plant parts of a) or the sifted and/or sorted plant parts of b) into bins, thereby producing bins of the plant parts.

Any embodiment herein shall be taken to apply mutatis mutandis to any other embodiment unless specifically stated otherwise.

The present invention is not to be limited in scope by the specific embodiments described herein, which are intended for the purpose of exemplification only. Functionally-equivalent products, compositions and methods are clearly within the scope of the invention, as described herein.

Throughout this specification, unless specifically stated otherwise or the context requires otherwise, reference to a single step, composition of matter, group of steps or group of compositions of matter shall be taken to encompass one and a plurality (i.e. one or more) of those steps, compositions of matter, groups of steps or group of compositions of matter.

The invention is hereinafter described by way of the following non-limiting Examples and with reference to the accompanying figures.

BRIEF DESCRIPTION OF THE ACCOMPANYING DRAWINGS

FIG. 1. A representation of various lipid synthesis pathways, most of which converge at DAG, a central molecule in lipid synthesis. This model includes one possible route to the formation of sn-2 MAG which could be used by a bi-functional MGAT/DGAT for DAG formation from glycerol-3-phosphate (G-3-P). Abbreviations are as follows:
  G-3-P; glycerol-3-phosphate
  LysoPA; lysophosphatidic acid
  PA; phosphatidic acid
  MAG; monoacylglycerol
  DAG; diacylglycerol
  TAG; triacylglycerol
  Acyl-CoA and FA-CoA; acyl-coenzyme A and fatty acyl-coenzyme A
  PC; phosphatidylcholine
  GPAT; glycerol-3-phosphate acyltransferase; glycerol-3-phosphate O-acyltransferase; acyl-CoA:sn-glycerol-3-phosphate 1-O-acyltransferase; EC 2.3.1.15
  GPAT4; glycerol-3-phosphate acyltransferase 4
  GPAT6; glycerol-3-phosphate acyltransferase 6
  LPAAT; 1-acyl-glycerol-3-phosphate acyltransferase; 1-acylglycerol-3-phosphate O-acyltransferase; acyl-CoA:1-acyl-sn-glycerol-3-phosphate 2-O-acyltransferase; EC 2.3.1.51
  PAP; phosphatidic acid phosphatase; phosphatidate phosphatase; phosphatic acid phosphohydrolase; phosphatidic acid phosphatase; EC 3.1.3.4
  MGAT; an acyltransferase having monoacylglycerol acyltransferase (MGAT; 2-acylglycerol O-acyltransferase acyl-CoA:2-acylglycerol O-acyltransferase; EC 2.3.1.22) activity
  M/DGAT; an acyltransferase having monoacylglycerol acyltransferase (MGAT; 2-acylglycerol O-acyltransferase; acyl-CoA:2-acylglycerol O-acyltransferase; EC 2.3.1.22) and/or diacylglycerol acyltransferase (DGAT; diacylglycerol O-acyltransferase; acyl-CoA:1,2-diacyl-sn-glycerol O-acyltransferase; EC 2.3.1.20) activity
  LPCAT; acyl-CoA:lysophosphatidylcholine acyltransferase; 1-acylglycerophosphocholine O-acyltransferase; acyl-CoA:1-acyl-sn-glycero-3-phosphocholine O-acyltransferase; EC 2.3.1.23
  PLD-Z; Phospholipase D zeta; choline phosphatase; lecithinase D; lipophosphodiesterase II; EC 3.1.4.4
  CPT; CDP-choline:diacylglycerol cholinephosphotransferase; 1-alkyl-2-acetylglycerol cholinephosphotransferase; alkylacylglycerol cholinephosphotransferase; cholinephosphotransferase; phosphorylcholine-glyceride transferase; EC 2.7.8.2
  PDCT; phosphatidylcholine:diacylglycerol cholinephosphotransferase
  PLC; phospholipase C; EC 3.1.4.3
  PDAT; phospholipid:diacylglycerol acyltransferase; phospholipid:1,2-diacyl-sn-glycerol O-acyltransferase; EC 2.3.1.158
  Pi; inorganic phosphate FIG. 2. Relative DAG and TAG increases in Nicotiana benthamiana leaf tissue transformed with constructs encoding p19 (negative control), Arabidopsis thaliana DGAT1, Mus musculus MGAT1 and a combination of DGAT1 and MGAT1, each expressed from the 35S promoter. The MGAT1 enzyme was far more active than the DGAT1 enzyme in promoting both DAG and TAG accumulation in leaf tissue. Expression of the MGAT1 gene resulted in twice as much DAG and TAG accumulation in leaf tissue compared to expression of DGAT1 alone.

Figure 3:
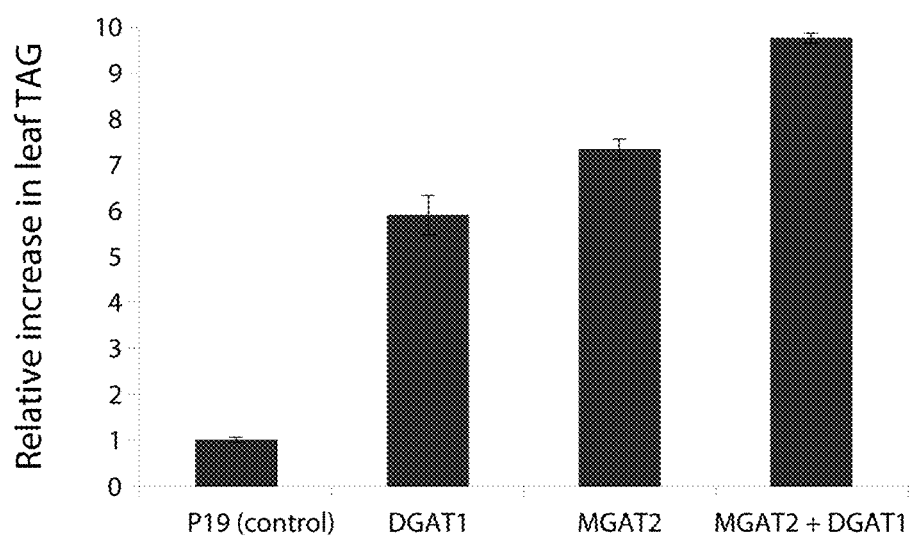

FIG. 3. Relative TAG increases in N. benthamiana leaf transformed with constructs encoding p19 (negative control), A. thaliana DGAT1, M. musculus MGAT2 and a combination of MGAT2 and DGAT1. Error bars denote standard error of triplicate samples.

Figure 4:
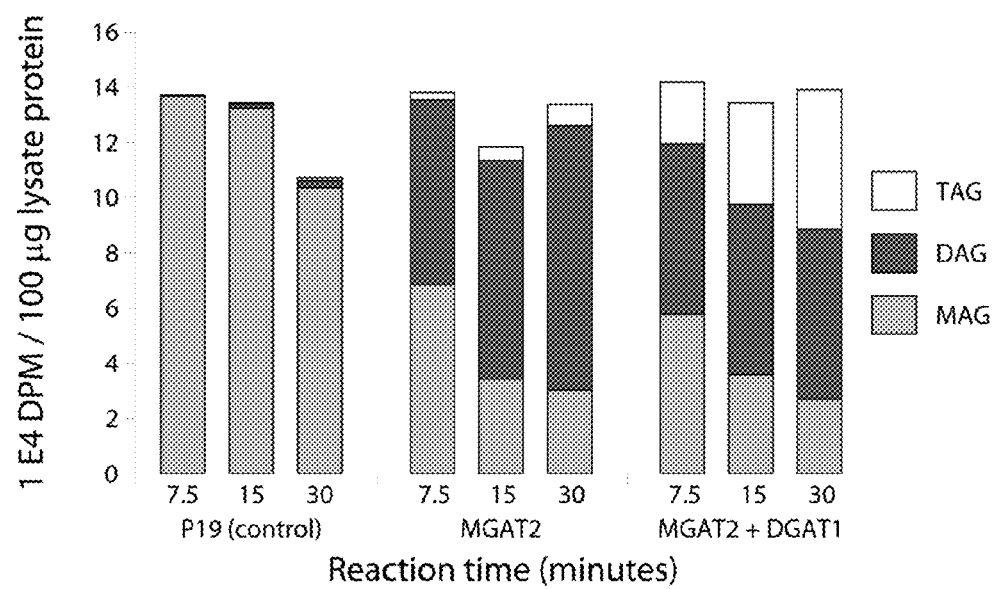

FIG. 4. Radioactivity (DPM) in MAG, DAG and TAG fractions isolated from transiently-transformed N. benthamiana leaf lysates fed with sn-2-MAG[$^{14}$C] and unlabelled oleic acid over a time-course. The constructs used were as for FIG. 3.

Figure 5:
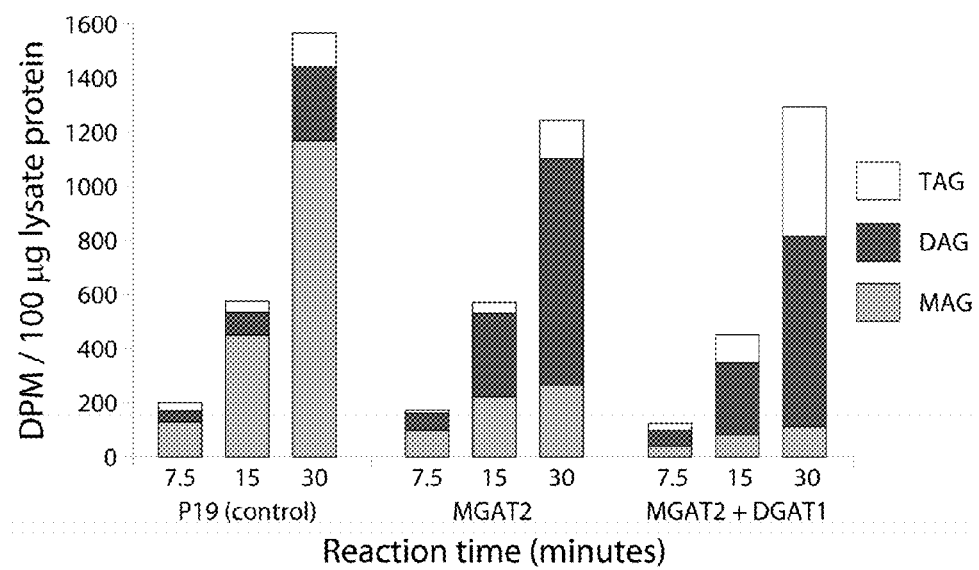

FIG. 5. As for FIG. 4 but fed [$^{14}$C]G-3-P and unlabelled oleic acid.

Figure 6:
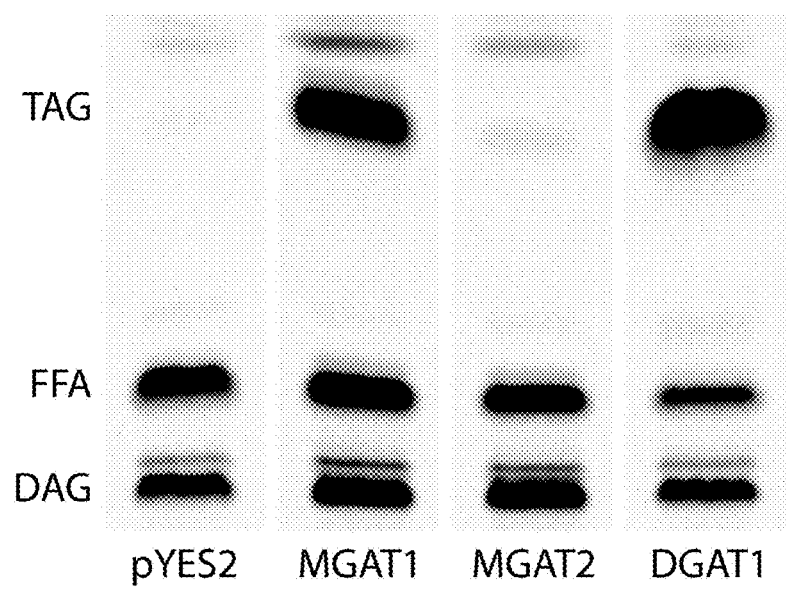

FIG. 6. Autoradiogram of TLC plate showing TAG-formation by A. thaliana DGAT1 and M. musculus MGAT1 but not M. musculus MGAT2 in yeast assays. The assay is described in Example 5.

Figure 7:
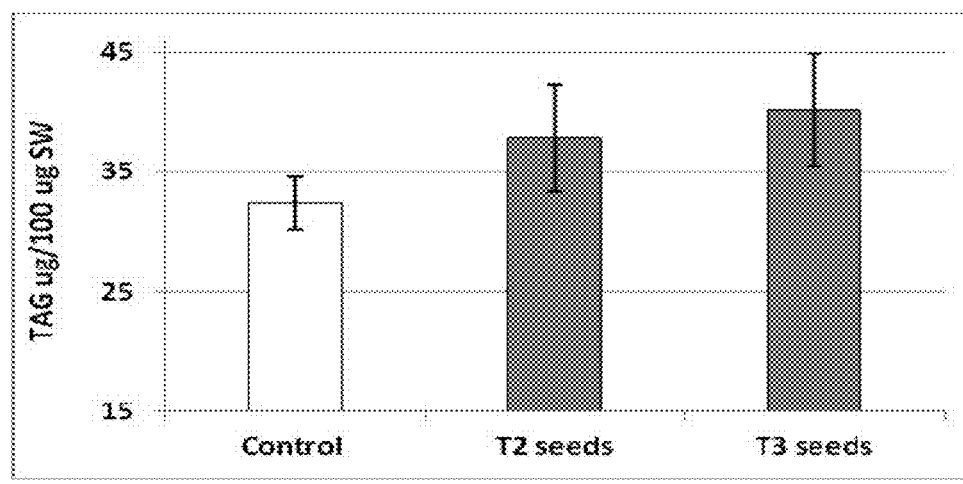

FIG. 7. TAG levels in Arabidopsis thaliana T2 and T3 seeds transformed with a chimeric DNA expressing MGAT2 relative to parental (untransformed) control. Seeds were harvested at maturity (dessicated). SW: desiccated seed weight. TAG levels are given as μg TAG per 100 μg seed weight.

Figure 8:
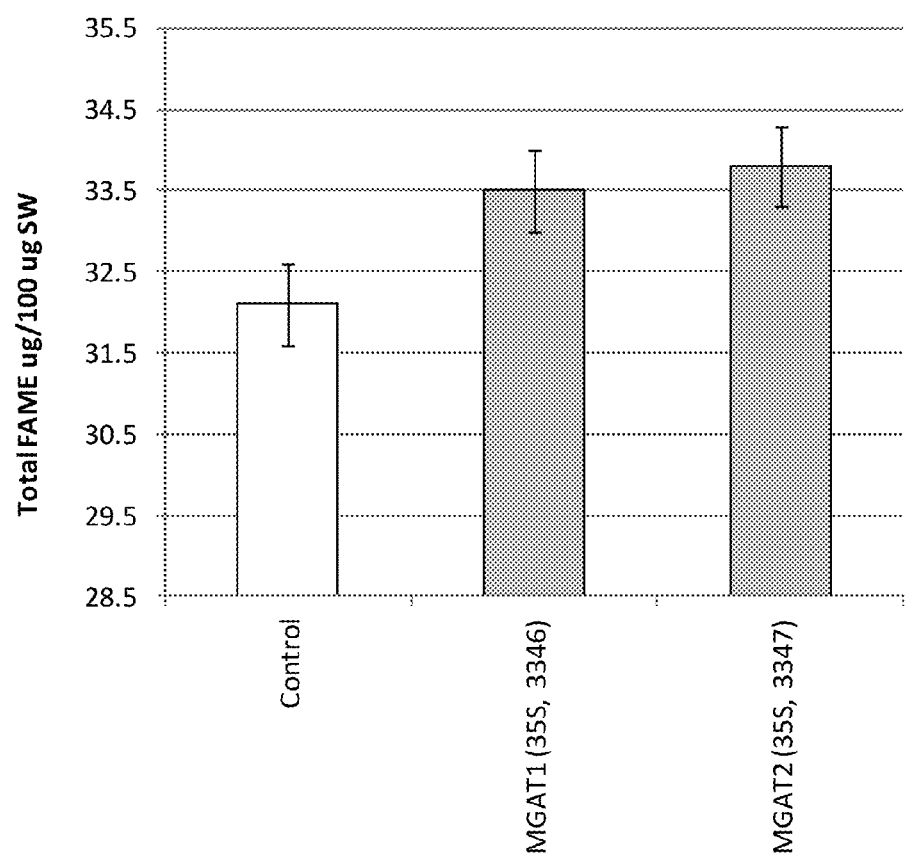

FIG. 8. Total fatty acid content in seed of transformed Arabidopsis thaliana plants transformed with constructs encoding MGAT1 or MGAT2.

Figure 9:
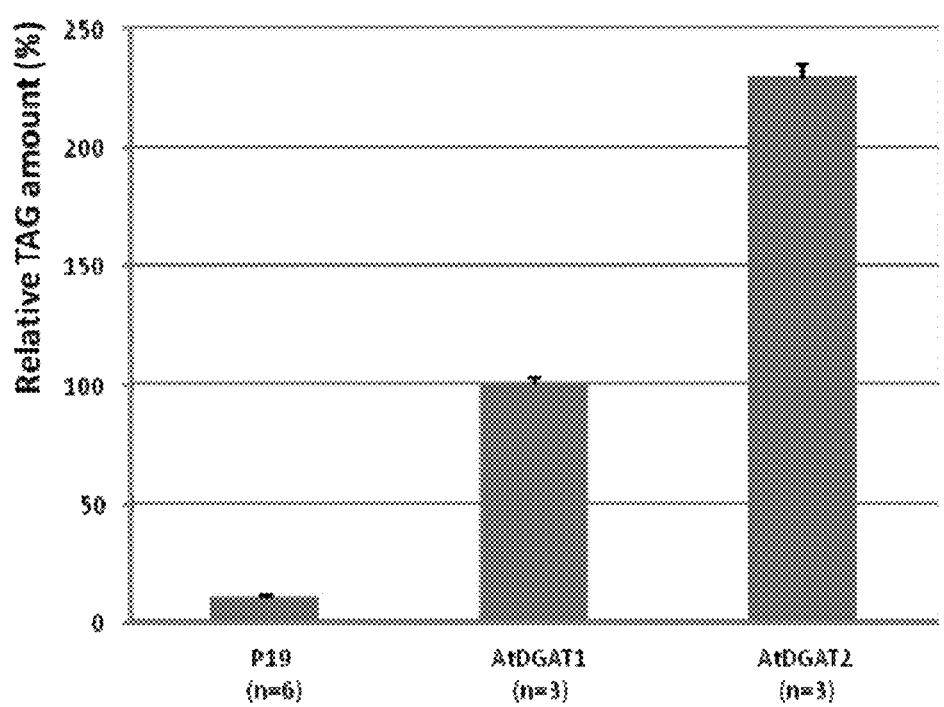

FIG. 9. Relative TAG level in transiently-transformed *N. benthamiana* leaf tissue compared to *Arabidopsis thaliana* DGAT1 overexpression.

Figure 10:
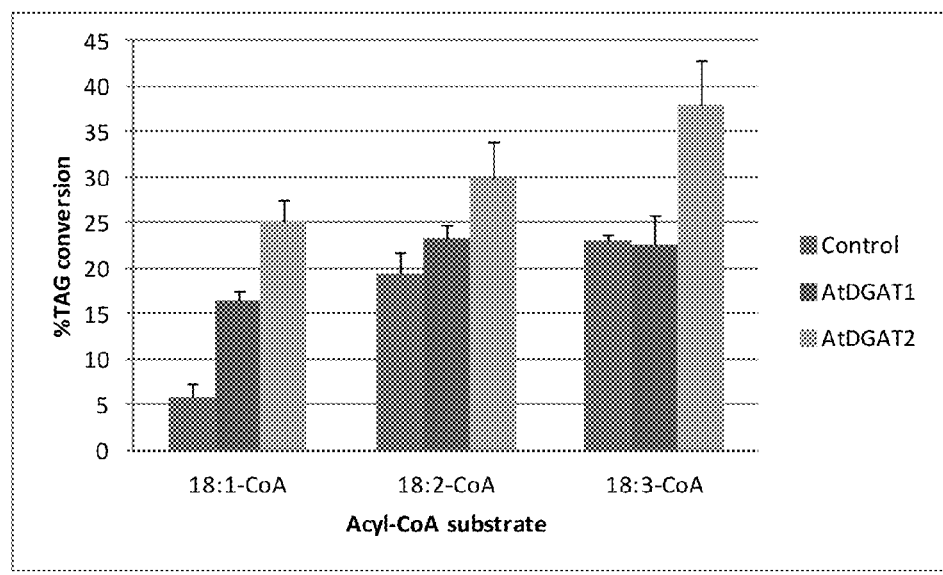

FIG. 10. TAG conversion from sn-1,2-DAG in DGAT assay from microsomes of *N. benthamiana* leaf tissues expressing P19 control, *Arabidopsis thaliana* DGAT1 and *Arabidopsis thaliana* DGAT2

Figure 11:
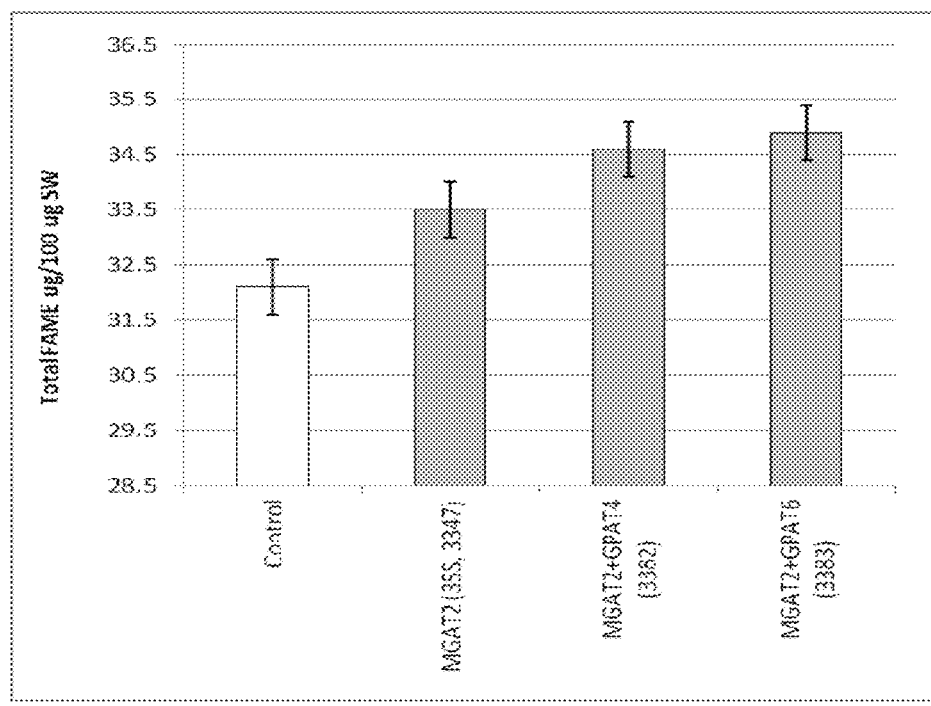

FIG. 11. Total FAME quantification in *A. thaliana* seeds transformed with pJP3382 and pJP3383.

Figure 12:
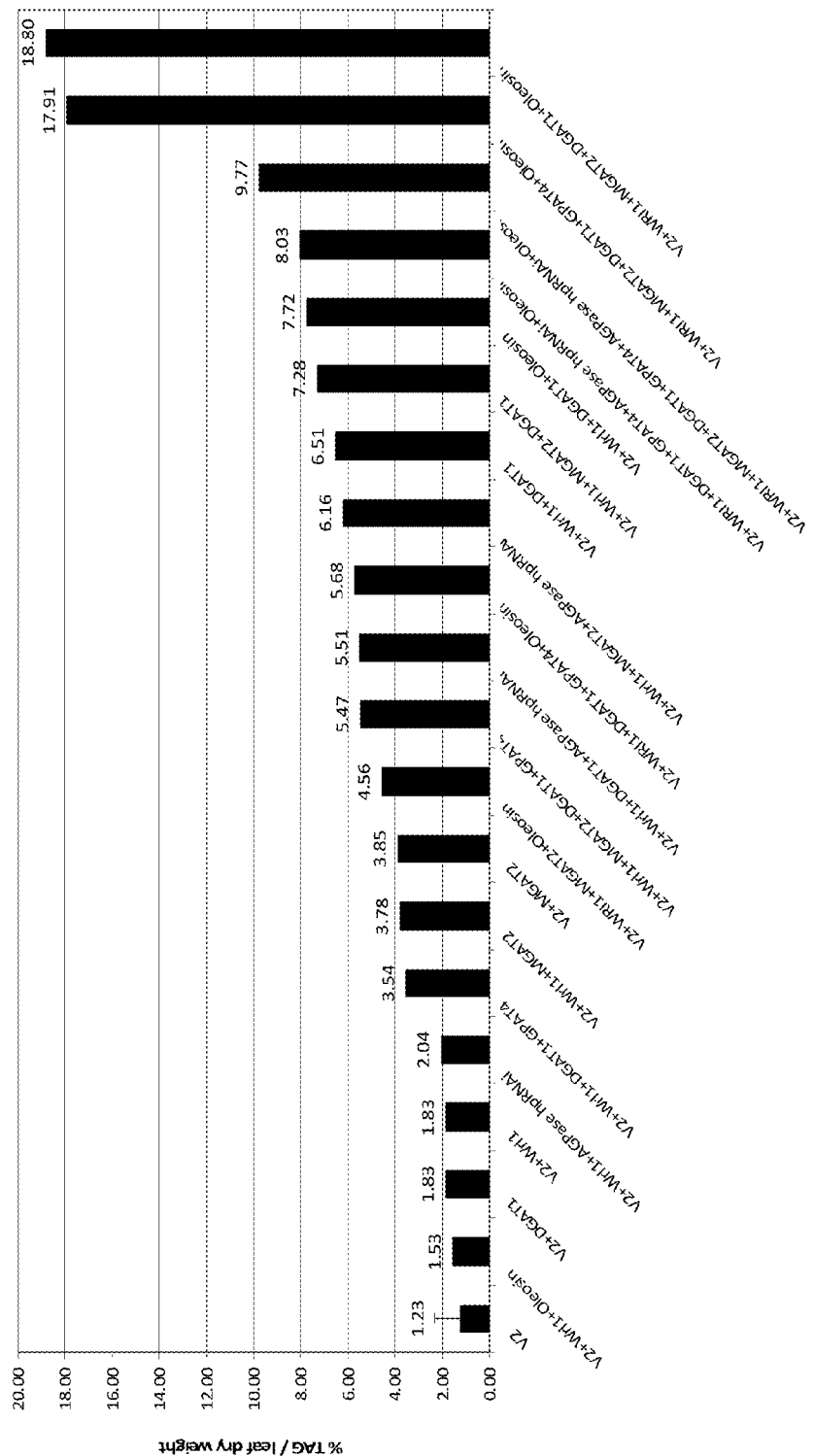

FIG. 12. Maximum TAG levels obtained for different gene combinations transiently expressed in *N. benthamiana* leaves. The V2 negative control represents the average TAG level based on 15 independent repeats.

Figure 13:
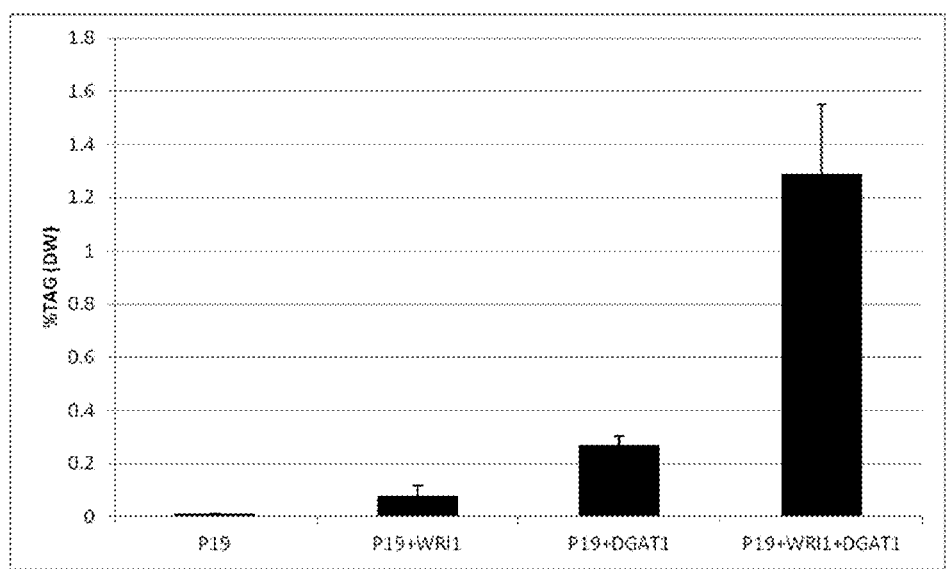

FIG. 13. Co-expression of the genes coding for the *Arabidopsis thaliana* DGAT1 acyltransferase and *A. thaliana* WRI1 transcription factor resulted in a synergistic effect on TAG levels in *Nicotiana benthamiana* leaves. Data shown are averages and standard deviations of five independent infiltrations.

Figure 14:
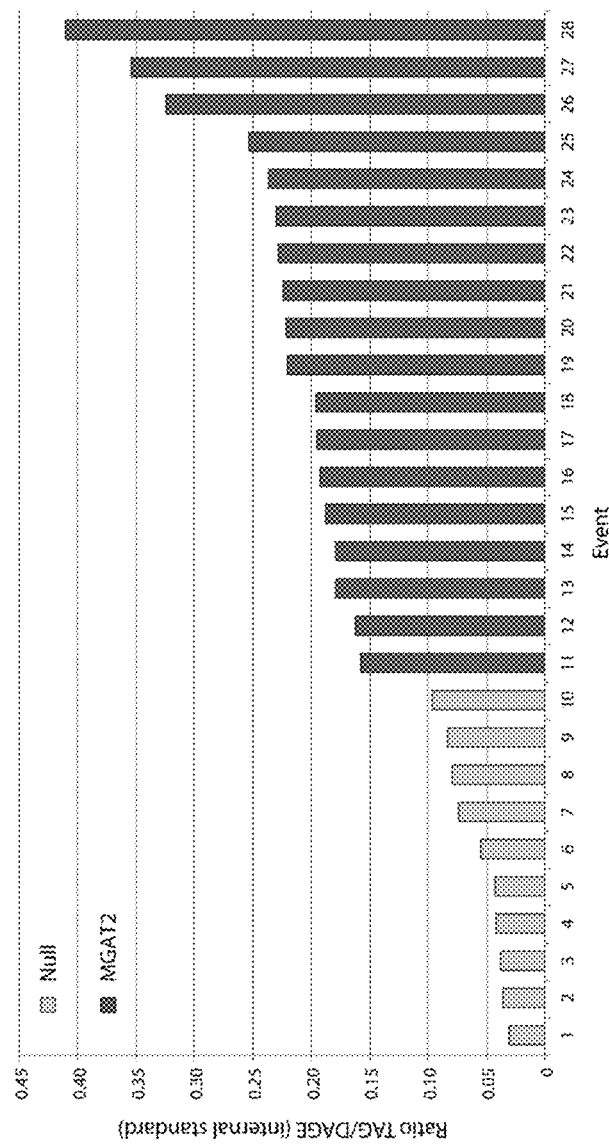

FIG. 14 TAG levels in stably-transformed *N. benthamiana* aerial seedling tissue. Total lipids were extracted from aerial tissues of *N. benthamiana* seedlings and analysed by TLC-FID using an internal DAGE standard to allow accurate comparison between samples.

Figure 15:
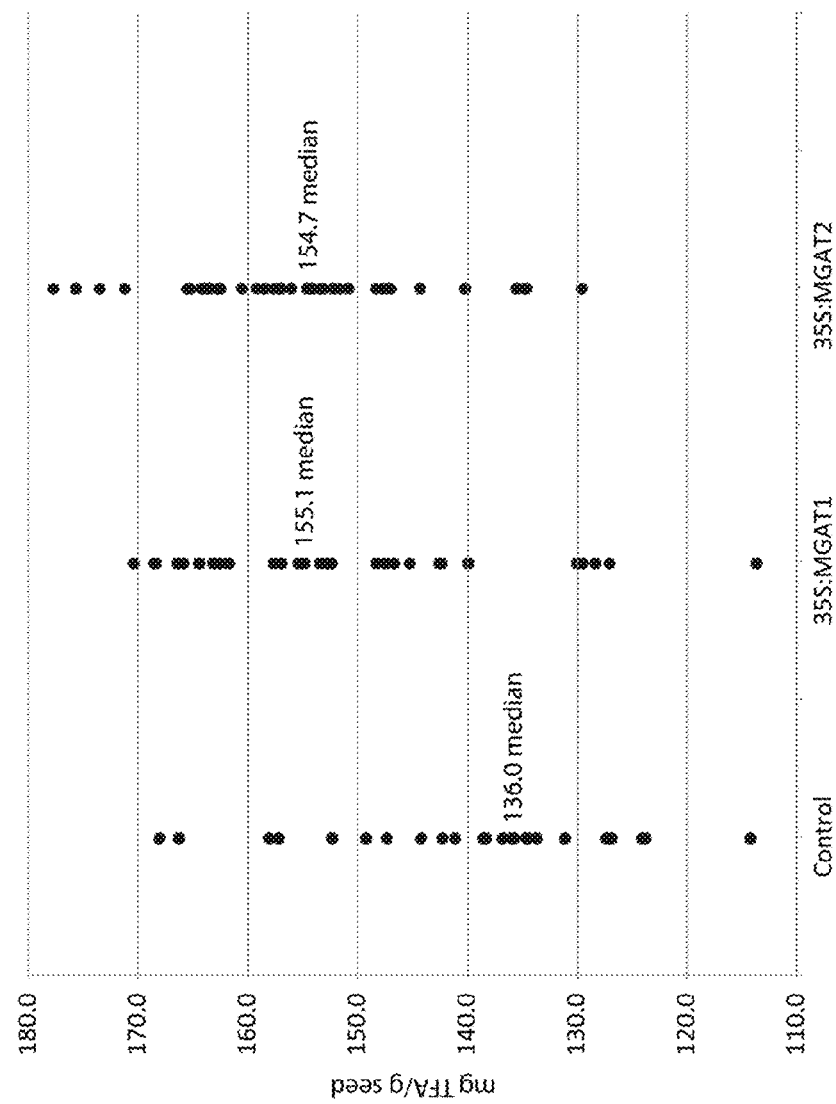

FIG. 15. Total fatty acid levels of *A. thaliana* T2 seed populations transformed with control vector (pORE04), *M. musculus* MGAT1 (35S:MGAT1) or *M. musculus* MGAT2 (35S:MGAT2).

Figure 16:
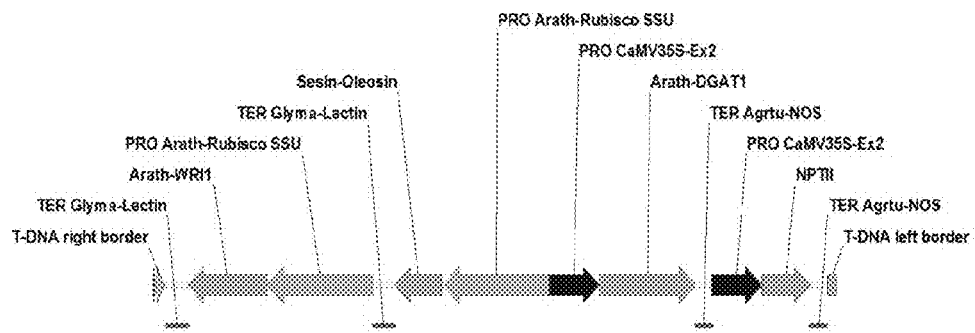

FIG. 16. Map of the insertion region between the left and right borders of pJP3502. TER Glyma-Lectin denotes the *Glycine max* lectin terminator; Arath-WRI1, *Arabidopsis thaliana* WRI1 transcription factor coding region; PRO Arath-Rubisco SSU, *A. thaliana* rubisco small subunit promotor; Sesin-Oleosin, *Sesame indicum* oleosin coding region; PRO CaMV35S-Ex2, cauliflower mosaic virus 35S promoter having a duplicated enhancer region; Arath-DGAT1, *A. thaliana* DGAT1 acyltransferase coding region; TER Agrtu-NOS, *Agrobacterium tumefaciens* nopaline synthase terminator.

Figure 17:
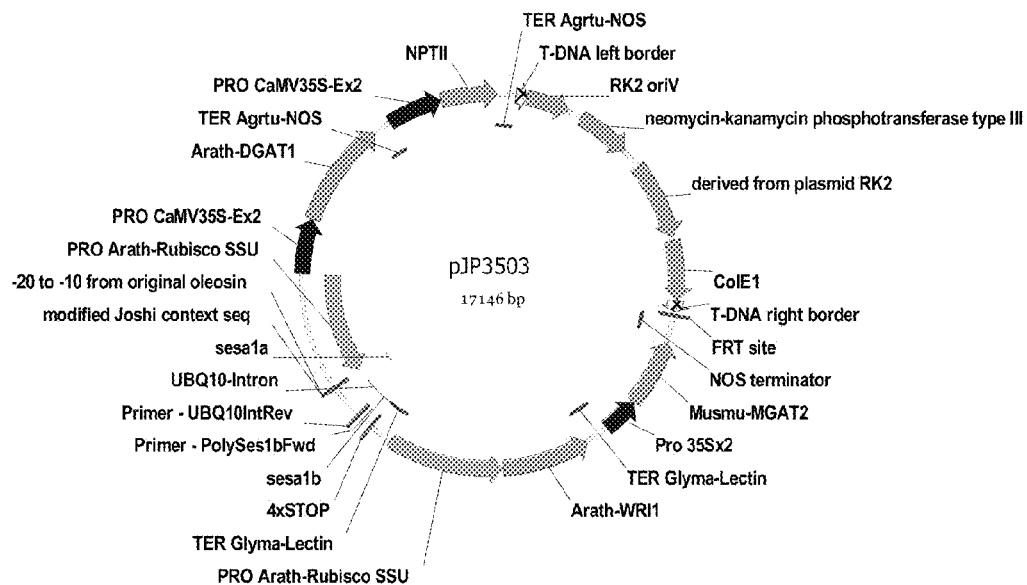

FIG. 17. Schematic representation of the construct pJP3503 including the insertion region between the left and right borders of pJP3503. TER Agrtu-NOS denotes the *Agrobacterium tumefaciens* nopaline synthase terminator; Musmu-MGAT2, *Mus Musculus* MGAT2 acyltransferase; PRO CaMV24S-Ex2, cauliflower mosaic virus 35S duplicated enhancer region; TER Glyma-Lectin, *Glycine max* lectin terminator; Arath-WRI1, *Arabidopsis thaliana* WRI1 transcription factor; PRO Arath-Rubisco SSU, *A. thaliana* rubisco small subunit promotor; Sesin-Oleosin, *Sesame indicum* oleosin; Arath-DGAT1, *A. thaliana* DGAT1 acyltransferase FIG. 18. TAG yields in different aged leaves of three wild type tobacco plants (wt1-3) and three pJP3503 primary transformants (4, 29, 21). Leaf stages are indicated by 'G', green; 'YG', yellow-green; 'Y', yellow. Plant stages during sampling were budding, wild type 1; first flowers appearing, wild type 2; flowering, wild type 3; producing seed pods (pJP3503 transformants).

Figure 19A:
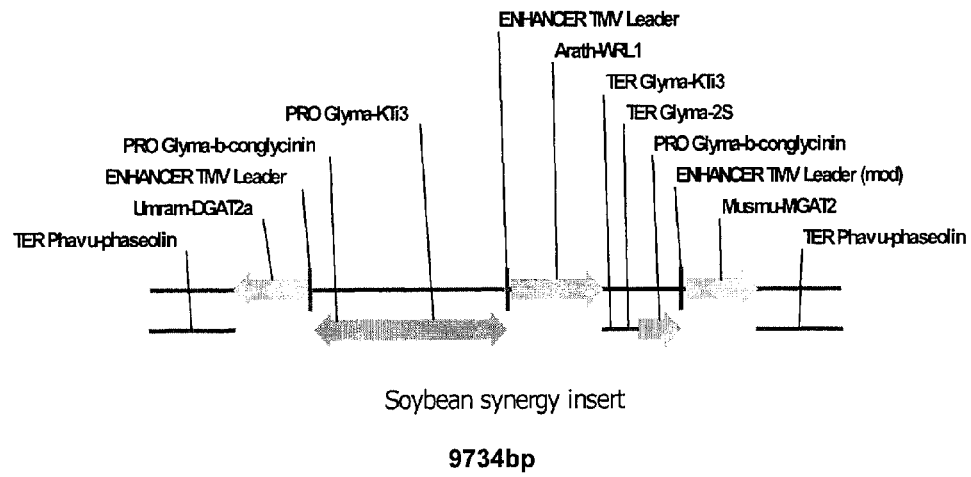

FIG. 19A. DNA insert containing expression cassettes for the *Umbelopsis ramanniana* DGAT2A expressed by the *Glycine max* alpha' subunit beta-conglycinin promoter, *Arabidopsis thaliana* WRI1 expressed by the *Glycine max* kunitz trypsin inhibitor 3 promoter and the *Mus musculus* MGAT2 expressed by the *Glycine max* alpha' subunit beta-conglycinin promoter. Gene coding regions and expression cassettes are excisable by restriction digestion.

Figure 19B:
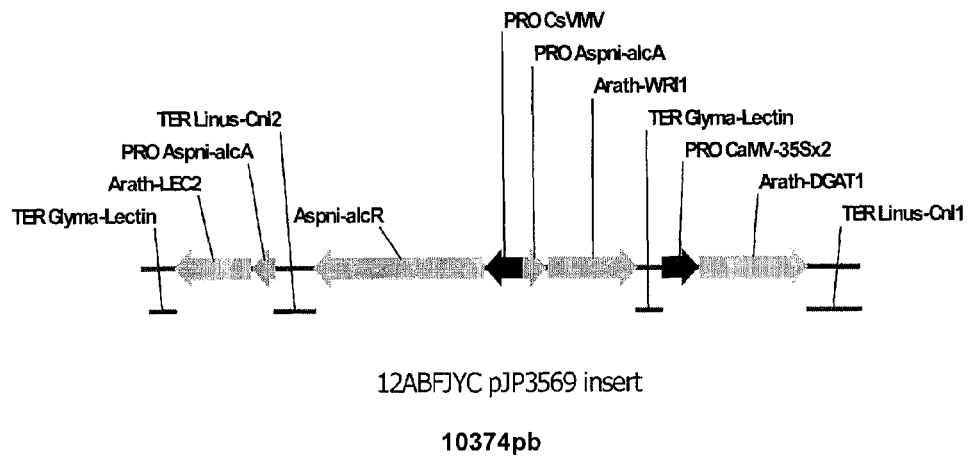

FIG. 19B. DNA insert containing expression cassettes for the *Arabidopsis thaliana* LEC2 and WRI1 transcription factor genes expressed by inducible *Aspergillus* alcA promoters, the *Arabidopsis thaliana* DGAT1 expressed by the constitutive CaMV-35S promoter and the *Aspergillus* alcR gene expressed by the constitutive CsVMV promoter. Expressed of the LEC2 and WRI1 transcription factors is induced by ethanol or an analagous compound.

Figure 20:
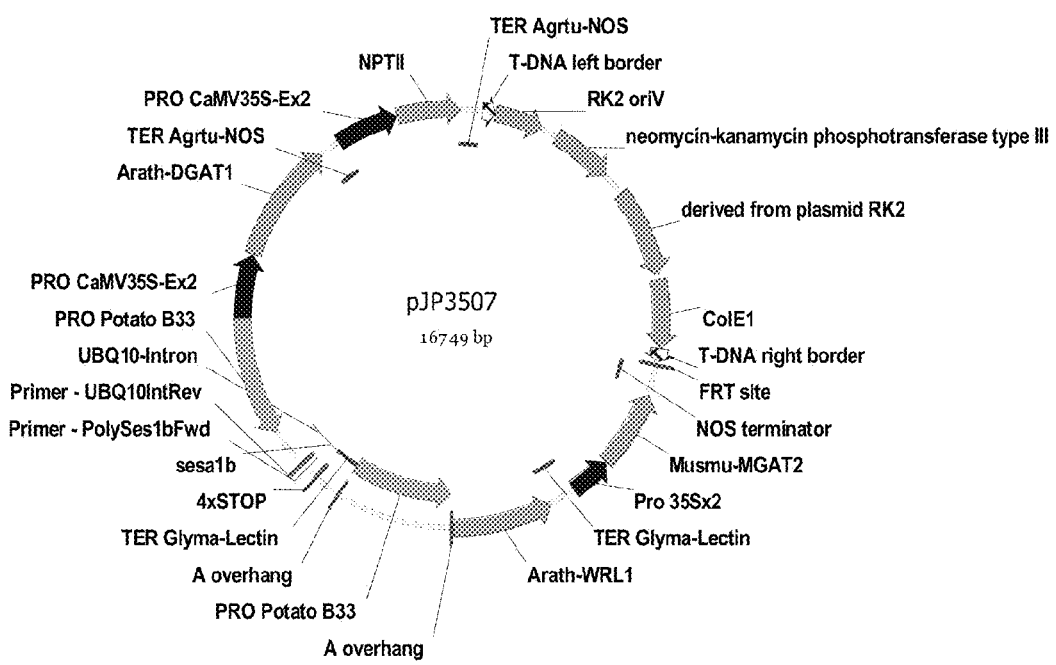

FIG. 20. pJP3507 map

Figure 21:
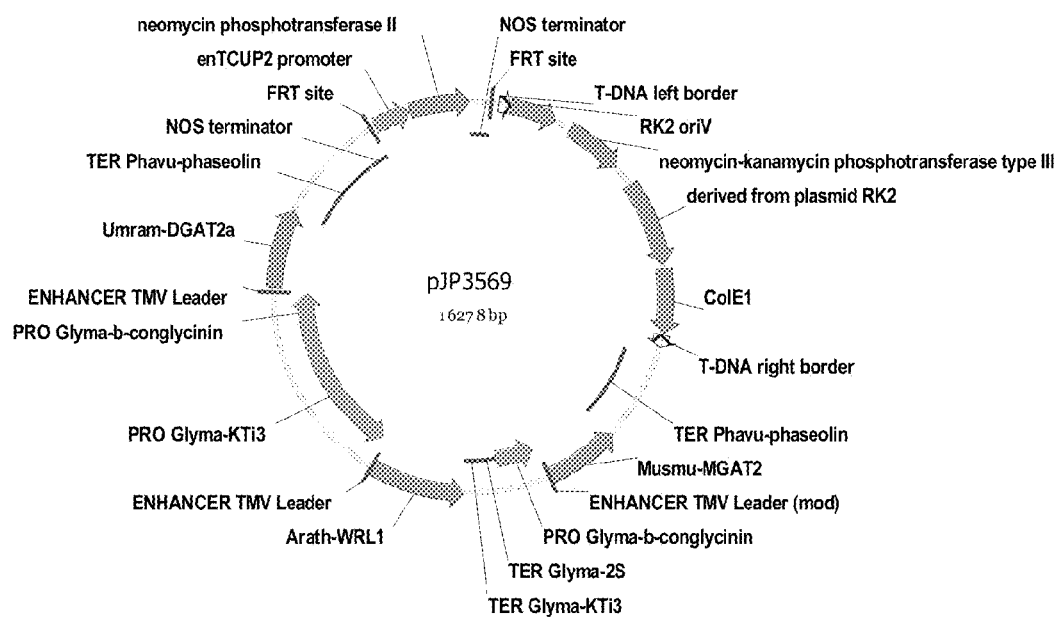

FIG. 21. pJP3569 map

KEY TO THE SEQUENCE LISTING

SEQ ID NO:1 *Mus musculus* codon optimised MGAT1
SEQ ID NO:2 *Mus musculus* codon optimised MGAT2
SEQ ID NO:3 *Ciona intestinalis* codon optimised MGAT1
SEQ ID NO:4 *Tribolium castaneum* codon optimised MGAT1
SEQ ID NO:5 *Danio rerio* codon optimised MGAT1
SEQ ID NO:6 *Danio rerio* codon optimised MGAT2
SEQ ID NO:7 *Homo sapiens* MGAT1 polynucleotide (AF384163)
SEQ ID NO:8 *Mus musculus* MGAT1 polynucleotide (AF384162)
SEQ ID NO:9 *Pan troglodytes* MGAT1 polynucleotide transcript variant (XM_001166055)
SEQ ID NO:10 *Pan troglodytes* MGAT1 polynucleotide transcript variant 2 (XM_0526044.2)
SEQ ID NO:11 *Canis familiaris* MGAT1 polynucleotide (XM_545667.2)
SEQ ID NO:12 *Bos taurus* MGAT1 polynucleotide (NM_001001153.2)
SEQ ID NO:13 *Rattus norvegicus* MGAT1 polynucleotide (NM_001108803.1)
SEQ ID NO:14 *Danio rerio* MGAT1 polynucleotide (NM_001122623.1)
SEQ ID NO:15 *Caenorhabditis elegans* MGAT1 polynucleotide (NM_073012.4)
SEQ ID NO:16 *Caenorhabditis elegans* MGAT1 polynucleotide (NM_182380.5)
SEQ ID NO:17 *Caenorhabditis elegans* MGAT1 polynucleotide (NM_065258.3)
SEQ ID NO:18 *Caenorhabditis elegans* MGAT1 polynucleotide (NM_075068.3)
SEQ ID NO:19 *Caenorhabditis elegans* MGAT1 polynucleotide (NM_072248.3)
SEQ ID NO:20 *Kluyveromyces lactis* MGAT1 polynucleotide (XM_455588.1)
SEQ ID NO:21 *Ashbya gossypii* MGAT1 polynucleotide (NM_208895.1)
SEQ ID NO:22 *Magnaporthe oryzae* MGAT1 polynucleotide (XM_368741.1)
SEQ ID NO:23 *Ciona intestinalis* MGAT1 polynucleotide (XM_002120843.1)
SEQ ID NO:24 *Homo sapiens* MGAT2 polynucleotide (AY157608)
SEQ ID NO:25 *Mus musculus* MGAT2 polynucleotide (AY157609)
SEQ ID NO:26 *Pan troglodytes* MGAT2 polynucleotide (XM_522112.2)
SEQ ID NO:27 *Canis familiaris* MGAT2 polynucleotide (XM_542304.1)
SEQ ID NO:28 *Bos taurus* MGAT2 polynucleotide (NM_001099136.1)
SEQ ID NO:29 *Rattus norvegicus* MGAT2 polynucleotide (NM_001109436.2)

SEQ ID NO:30 *Gallus gallus* MGAT2 polynucleotide (XM_424082.2)

SEQ ID NO:31 *Danio rerio* MGAT2 polynucleotide (NM_001006083.1)

SEQ ID NO:32 *Drosophila melanogaster* MGAT2 polynucleotide (NM_136474.2)

SEQ ID NO:33 *Drosophila melanogaster* MGAT2 polynucleotide (NM_136473.2)

SEQ ID NO:34 *Drosophila melanogaster* MGAT2 polynucleotide (NM_136475.2)

SEQ ID NO:35 *Anopheles gambiae* MGAT2 polynucleotide (XM_001688709.1)

SEQ ID NO:36 *Anopheles gambiae* MGAT2 polynucleotide (XM_315985)

SEQ ID NO:37 *Tribolium castaneum* MGAT2 polynucleotide (XM_970053.1)

SEQ ID NO:38 *Homo sapiens* MGAT3 polynucleotide (AY229854)

SEQ ID NO:39 *Pan troglodytes* MGAT3 polynucleotide transcript variant 1 (XM_001154107.1)

SEQ ID NO:40 *Pan troglodytes* MGAT3 polynucleotide transcript variant 2 (XM_001154171.1)

SEQ ID NO:41 *Pan troglodytes* MGAT3 polynucleotide transcript variant 3 (XM_527842.2)

SEQ ID NO:42 *Canis familiaris* MGAT3 polynucleotide (XM_845212.1)

SEQ ID NO:43 *Bos taurus* MGAT3 polynucleotide (XM_870406.4)

SEQ ID NO:44 *Danio rerio* MGAT3 polynucleotide (XM_688413.4)

SEQ ID NO:45 *Homo sapiens* MGAT1 polypeptide (AAK84178.1)

SEQ ID NO:46 *Mus musculus* MGAT1 polypeptide (AAK84177.1)

SEQ ID NO:47 *Pan troglodytes* MGAT1 polypeptide isoform 1 (XP_001166055.1)

SEQ ID NO:48 *Pan troglodytes* MGAT 1 polypeptide isoform 2 (XP_526044.2)

SEQ ID NO:49 *Canis familiaris* MGAT1 polypeptide (XP_545667.2)

SEQ ID NO:50 *Bos taurus* MGAT1 polypeptide (NP_001001153.1)

SEQ ID NO:51 *Rattus norvegicus* MGAT1 polypeptide (NP_001102273.1)

SEQ ID NO:52 *Danio rerio* MGAT1 polypeptide (NP_001116095.1)

SEQ ID NO:53 *Caenorhabditis elegans* MGAT1 polypeptide (NP_505413.1)

SEQ ID NO:54 *Caenorhabditis elegans* MGAT1 polypeptide (NP_872180.1)

SEQ ID NO:55 *Caenorhabditis elegans* MGAT1 polypeptide (NP_497659.1)

SEQ ID NO:56 *Caenorhabditis elegans* MGAT1 polypeptide (NP_507469.1)

SEQ ID NO:57 *Caenorhabditis elegans* MGAT1 polypeptide (NP_504649.1)

SEQ ID NO:58 *Kluyveromyces lactis* MGAT1 polypeptide (XP_455588.1)

SEQ ID NO:59 *Ashbya gossypii* MGAT1 polypeptide (NP_983542.1)

SEQ ID NO:60 *Magnaporthe oryzae* MGAT1 polypeptide (XP_368741.1)

SEQ ID NO:61 *Ciona intestinalis* MGAT1 polypeptide (XP_002120879)

SEQ ID NO:62 *Homo sapiens* MGAT2 polypeptide (AAO23672.1)

SEQ ID NO:63 *Mus musculus* MGAT2 polypeptide (AAO23673.1)

SEQ ID NO:64 *Pan troglodytes* MGAT2 polypeptide (XP_522112.2)

SEQ ID NO:65 *Canis familiaris* MGAT2 polypeptide (XP_542304.1)

SEQ ID NO:66 *Bos taurus* MGAT2 polypeptide (NP_001092606.1)

SEQ ID NO:67 *Rattus norvegicus* MGAT2 polypeptide (NP_001102906.2)

SEQ ID NO:68 *Gallus gallus* MGAT2 polypeptide (XP_424082.2)

SEQ ID NO:69 *Danio rerio* MGAT2 polypeptide (NP_001006083.1)

SEQ ID NO:70 *Drosophila melanogaster* MGAT2 polypeptide (NP_610318.1)

SEQ ID NO:71 *Drosophila melanogaster* MGAT2 polypeptide (NP_610317.1)

SEQ ID NO:72 *Drosophila melanogaster* MGAT2 polypeptide (NP_610319.2)

SEQ ID NO:73 *Anopheles gambiae* MGAT2 polypeptide (XP_001688761)

SEQ ID NO:74 *Anopheles gambiae* MGAT2 polypeptide (XP_315985.3)

SEQ ID NO:75 *Tribolium castaneum* MGAT2 polypeptide (XP_975146)

SEQ ID NO:76 *Homo sapiens* MGAT3 polypeptide (AAO63579.1)

SEQ ID NO:77 *Pan troglodytes* MGAT3 polypeptide isoform 1 (XP_001154107.1)

SEQ ID NO:78 *Pan troglodytes* MGAT3 polypeptide isoform 2 (XP_001154171.1)

SEQ ID NO:79 *Pan troglodytes* MGAT3 isoform 3 (XP_527842.2)

SEQ ID NO:80 *Canis familiaris* MGAT3 polypeptide (XP_850305.1)

SEQ ID NO:81 *Bos taurus* MGAT3 polypeptide (XP_875499.3)

SEQ ID NO:82 *Danio rerio* MGAT3 polypeptide (XP_693505.1)

SEQ ID NO:83 *Arabidopsis thaliana* DGAT1 polypeptide (CAB44774.1)

SEQ ID NO:84 *Arabidopsis thaliana* GPAT4 polynucleotide (NM_100043.4)

SEQ ID NO:85 *Arabidopsis thaliana* GPAT6 polynucleotide (NM_129367.3)

SEQ ID NO:86 *Arabidopsis thaliana* GPAT polynucleotide (AF195115.1)

SEQ ID NO:87 *Arabidopsis thaliana* GPAT polynucleotide (AY062466.1)

SEQ ID NO:88 *Oryza sativa* GPAT polynucleotide (AC118133.4)

SEQ ID NO:89 *Picea sitchensis* GPAT polynucleotide (EF086095.1)

SEQ ID NO:90 *Zea mays* GPAT polynucleotide (BT067649.1)

SEQ ID NO:91 *Arabidopsis thaliana* GPAT polynucleotide (AK228870.1)

SEQ ID NO:92 *Oryza sativa* GPAT polynucleotide (AK241033.1)

SEQ ID NO:93 *Oryza sativa* GPAT polynucleotide (CM000127.1)

SEQ ID NO:94 *Oryza sativa* GPAT polynucleotide (CM000130.1)

SEQ ID NO:95 *Oryza sativa* GPAT polynucleotide (CM000139.1)

SEQ ID NO:96 *Oryza sativa* GPAT polynucleotide (CM000126.1)

SEQ ID NO:97 *Oryza sativa* GPAT polynucleotide (CM000128.1)

SEQ ID NO:98 *Oryza sativa* GPAT polynucleotide (CM000140.1)

SEQ ID NO:99 *Selaginella moellendorffii* GPAT polynucleotide (GL377667.1)

SEQ ID NO:100 *Selaginella moellendorffii* GPAT polynucleotide (GL377667.1)

SEQ ID NO:101 *Selaginella moellendorffii* GPAT polynucleotide (GL377648.1)

SEQ ID NO:102 *Selaginella moellendorffii* GPAT polynucleotide (GL377622.1)

SEQ ID NO:103 *Selaginella moellendorffii* GPAT polynucleotide (GL377590.1)

SEQ ID NO:104 *Selaginella moellendorffii* GPAT polynucleotide (GL377576.1)

SEQ ID NO:105 *Selaginella moellendorffii* GPAT polynucleotide (GL377576.1)

SEQ ID NO:106 *Oryza sativa* GPAT polynucleotide (NM_001051374.2)

SEQ ID NO:107 *Oryza sativa* GPAT polynucleotide (NM_001052203.1)

SEQ ID NO:108: *Zea mays* GPAT8 polynucleotide (NM_001153970.1)

SEQ ID NO:109: *Zea mays* GPAT polynucleotide (NM_001155835.1)

SEQ ID NO:110: *Zea mays* GPAT polynucleotide (NM_001174880.1)

SEQ ID NO:111 *Brassica napus* GPAT4 polynucleotide (JQ666202.1)

SEQ ID NO:112 *Arabidopsis thaliana* GPAT8 polynucleotide (NM_116264.5)

SEQ ID NO:113 *Physcomitrella patens* GPAT polynucleotide (XM_001764949.1)

SEQ ID NO:114 *Physcomitrella patens* GPAT polynucleotide (XM_001769619.1)

SEQ ID NO:115 *Physcomitrella patens* GPAT polynucleotide (XM_001769672.1)

SEQ ID NO:116 *Physcomitrella patens* GPAT polynucleotide (XM_001771134.1)

SEQ ID NO:117 *Physcomitrella patens* GPAT polynucleotide (XM_001780481.1)

SEQ ID NO:118 *Vitis vinifera* GPAT polynucleotide (XM_002268477.1)

SEQ ID NO:119 *Vitis vinifera* GPAT polynucleotide (XM_002275312.1)

SEQ ID NO:120 *Vitis vinifera* GPAT polynucleotide (XM_002275996.1)

SEQ ID NO:121 *Vitis vinifera* GPAT polynucleotide (XM_002279055.1)

SEQ ID NO:122 *Populus trichocarpa* GPAT polynucleotide (XM_002309088.1)

SEQ ID NO:123 *Populus trichocarpa* GPAT polynucleotide (XM_002309240.1)

SEQ ID NO:124 *Populus trichocarpa* GPAT polynucleotide (XM_002322716.1)

SEQ ID NO:125 *Populus trichocarpa* GPAT polynucleotide (XM_002323527.1)

SEQ ID NO:126 *Sorghum bicolor* GPAT polynucleotide (XM_002439842.1)

SEQ ID NO:127 *Sorghum bicolor* GPAT polynucleotide (XM_002458741.1)

SEQ ID NO:128 *Sorghum bicolor* GPAT polynucleotide (XM_002463871.1)

SEQ ID NO:129 *Sorghum bicolor* GPAT polynucleotide (XM_002464585.1)

SEQ ID NO:130 *Ricinus communis* GPAT polynucleotide (XM_002511827.1)

SEQ ID NO:131 *Ricinus communis* GPAT polynucleotide (XM_002517392.1)

SEQ ID NO:132 *Ricinus communis* GPAT polynucleotide (XM_002520125.1)

SEQ ID NO:133 *Arabidopsis lyrata* GPAT polynucleotide (XM_002872909.1)

SEQ ID NO:134 *Arabidopsis lyrata* GPAT6 polynucleotide (XM_002881518.1)

SEQ ID NO 135 *Vernicia fordii* putative GPAT8 polynucleotide (FJ479753.1)

SEQ ID NO 136 *Oryza sativa* GPAT polynucleotide (NM_001057724.1)

SEQ ID NO:137 *Brassica napus* GPAT4 polynucleotide (JQ666203.1) SEQ ID NO 138 *Populus trichocarpa* GPAT polynucleotide (XM_002320102.1)

SEQ ID NO:139 *Sorghum bicolor* GPAT polynucleotide (XM_002451332.1)

SEQ ID NO:140 *Ricinus communis* GPAT polynucleotide (XM_002531304.1)

SEQ ID NO:141 *Arabidopsis lyrata* GPAT4 polynucleotide (XM_002889315.1)

SEQ ID NO:142 *Arabidopsis thaliana* GPAT1 polynucleotide (NM_100531.2)

SEQ ID NO 143 *Arabidopsis thaliana* GPAT3 polynucleotide (NM_116426.2)

SEQ ID NO:144 *Arabidopsis thaliana* GPAT4 polypeptide (NP_171667.1)

SEQ ID NO:145 *Arabidopsis thaliana* GPAT6 polypeptide (NP_181346.1)

SEQ ID NO:146 *Arabidopsis thaliana* GPAT polypeptide (AAF02784.1)

SEQ ID NO:147 *Arabidopsis thaliana* GPAT polypeptide (AAL32544.1)

SEQ ID NO:148 *Oryza sativa* GPAT polypeptide (AAP03413.1)

SEQ ID NO:149 *Picea sitchensis* GPAT polypeptide (ABK25381.1)

SEQ ID NO:150 *Zea mays* GPAT polypeptide (ACN34546.1)

SEQ NO ID:151 *Arabidopsis thaliana* GPAT polypeptide (BAF00762.1)

SEQ ID NO:152 *Oryza sativa* GPAT polypeptide (BAH00933.1)

SEQ ID NO:153 *Oryza sativa* GPAT polypeptide (EAY84189.1)

SEQ ID NO:154 *Oryza sativa* GPAT polypeptide (EAY98245.1)

SEQ ID NO:155 *Oryza sativa* GPAT polypeptide (EAZ21484.1)

SEQ ID NO:156 *Oryza sativa* GPAT polypeptide (EEC71826.1)

SEQ ID NO:157 *Oryza sativa* GPAT polypeptide (EEC76137.1)

SEQ ID NO:158 *Oryza sativa* GPAT polypeptide (EEE59882.1)

SEQ ID NO:159 *Selaginella moellendorffii* GPAT polypeptide (EFJ08963.1)

SEQ ID NO:160 *Selaginella moellendorffii* GPAT polypeptide (EFJ08964.1)

SEQ ID NO:161 *Selaginella moellendorffii* GPAT polypeptide (EFJ11200.1)

SEQ ID NO:162 *Selaginella moellendorffii* GPAT polypeptide (EFJ15664.1)

SEQ ID NO:163 *Selaginella moellendorffii* GPAT polypeptide (EFJ24086.1)

SEQ ID NO:164 *Selaginella moellendorffii* GPAT polypeptide (EFJ29816.1)

SEQ ID NO:165 *Selaginella moellendorffii* GPAT polypeptide (EFJ29817.1)

SEQ ID NO:166 *Oryza sativa* GPAT polypeptide (NP_001044839.1)

SEQ ID NO:167 *Oryza sativa* GPAT polypeptide (NP_001045668.1)

SEQ ID NO:168 *Zea mays* GPAT 8 polypeptide (NP_001147442.1)

SEQ ID NO:169 *Zea mays* GPAT polypeptide (NP_001149307.1)

SEQ ID NO:170 *Zea mays* protein GPAT polypeptide (NP_001168351.1)

SEQ ID NO:171 *Brassica napus* GPAT4 polypeptide (AFH02724.1)

SEQ ID NO:172 *Arabidopsis thaliana* GPAT8 polypeptide (NP_191950.2)

SEQ ID NO:173 *Physcomitrella patens* GPAT polypeptide (XP_001765001.1)

SEQ ID NO:174 *Physcomitrella patens* GPAT polypeptide (XP_001769671.1)

SEQ ID NO:175 *Physcomitrella patens* GPAT polypeptide (XP_001769724.1)

SEQ ID NO:176 *Physcomitrella patens* GPAT polypeptide (XP_001771186.1)

SEQ ID NO:177 *Physcomitrella patens* GPAT polypeptide (XP_001780533.1)

SEQ ID NO:178 *Vitis vinifera* GPAT polypeptide (XP_002268513.1)

SEQ ID NO:179 *Vitis vinifera* GPAT polypeptide (XP_002275348.1)

SEQ ID NO:180 *Vitis vinifera* GPAT polypeptide (XP_002276032.1)

SEQ ID NO:181 *Vitis vinifera* GPAT polypeptide (XP_002279091.1)

SEQ ID NO:182 *Populus trichocarpa* GPAT polypeptide (XP_002309124.1)

SEQ ID NO:183 *Populus trichocarpa* GPAT polypeptide (XP_002309276.1)

SEQ ID NO:184 *Populus trichocarpa* GPAT polypeptide (XP_002322752.1)

SEQ ID NO:185 *Populus trichocarpa* GPAT polypeptide (XP_002323563.1)

SEQ ID NO:186 *Sorghum bicolor* GPAT polypeptide (XP_002439887.1)

SEQ ID NO:187 *Sorghum bicolor* GPAT polypeptide (XP_002458786.1)

SEQ ID NO:188 *Sorghum bicolor* GPAT polypeptide (XP_002463916.1)

SEQ ID NO:189 *Sorghum bicolor* GPAT polypeptide (XP_002464630.1)

SEQ ID NO:190 *Ricinus communis* GPAT polypeptide (XP_002511873.1)

SEQ ID NO:191 *Ricinus communis* GPAT polypeptide (XP_002517438.1)

SEQ ID NO:192 *Ricinus communis* GPAT polypeptide (XP_002520171.1)

SEQ ID NO:193 *Arabidopsis lyrata* GPAT polypeptide (XP_002872955.1)

SEQ ID NO:194 *Arabidopsis lyrata* GPAT6 polypeptide (XP_002881564.1)

SEQ ID NO:195 *Vernicia fordii* GPAT polypeptide (ACT32032.1)

SEQ ID NO:196 *Oryza sativa* GPAT polypeptide (NP_001051189.1)

SEQ ID NO:197 *Brassica napus* GPAT4 polypeptide (AFH02725.1)

SEQ ID NO:198 *Populus* trichocarpa GPAT polypeptide (XP_002320138.1)

SEQ ID NO:199 *Sorghum bicolor* GPAT polypeptide (XP_002451377.1)

SEQ ID NO:200 *Ricinus communis* GPAT polypeptide (XP_002531350.1)

SEQ ID NO:201 *Arabidopsis lyrata* GPAT4 polypeptide (XP_002889361.1)

SEQ ID NO:202 *Arabidopsis thaliana* GPAT1 polypeptide (NP_563768.1)

SEQ ID NO:203 *Arabidopsis thaliana* GPAT3 polypeptide (NP_192104.1)

SEQ ID NO:204 *Arabidopsis thaliana* DGAT2 polynucleotide (NM_115011.3)

SEQ ID NO:205 *Ricinus communis* DGAT2 polynucleotide (AY916129.1)

SEQ ID NO:206 *Vernicia fordii* DGAT2 polynucleotide (DQ356682.1)

SEQ ID NO:207 *Mortierella ramanniana* DGAT2 polynucleotide (AF391089.1)

SEQ ID NO:208 *Homo sapiens* DGAT2 polynucleotide (NM_032564.1)

SEQ ID NO:209 *Homo sapiens* DGAT2 polynucleotide (NM_001013579.2)

SEQ ID NO:210 *Bos taurus* DGAT2 polynucleotide (NM_205793.2)

SEQ ID NO:211 *Mus musculus* DGAT2 polynucleotide (AF384160.1)

SEQ ID NO:212 *Arabidopsis thaliana* DGAT2 polypeptide (NP_566952.1)

SEQ ID NO:213 *Ricinus communis* DGAT2 polypeptide (AAY16324.1)

SEQ ID NO:214 *Vernicia fordii* DGAT2 polypeptide (ABC94474.1)

SEQ ID NO:215 *Mortierella* ramanniana DGAT2 polypeptide (AAK84179.1)

SEQ ID NO:216 *Homo sapiens* DGAT2 polypeptide (Q96PD7.2)

SEQ ID NO:217 *Homo sapiens* DGAT2 polypeptide (Q58HT5.1)

SEQ ID NO:218 *Bos taurus* DGAT2 polypeptide (Q70VZ8.1)

SEQ ID NO:219 *Mus musculus* DGAT2 polypeptide (AAK84175.1)

SEQ ID NO:220 YFP tripeptide—conserved DGAT2 and/or MGAT1/2 sequence motif

SEQ ID NO:221 HPHG tetrapeptide—conserved DGAT2 and/or MGAT1/2 sequence motif

SEQ ID NO:222 EPHS tetrapeptide—conserved plant DGAT2 sequence motif

SEQ ID NO:223 RXGFX(K/R)XAXXXGXXX(L/V)VPXXXFG(E/Q)—long conserved sequence motif of DGAT2 which is part of the putative glycerol phospholipid domain SEQ ID NO:224 FLXLXXXN—conserved sequence motif of mouse DGAT2 and MGAT1/2 which is a putative neutral lipid binding domain SEQ ID NO:225 plsC acyltransferase domain (PF01553) of GPAT SEQ ID NO:226 HAD-like hydrolase (PF12710) superfamily domain of GPAT SEQ ID NO:227 Phosphoserine phosphatase domain (PF00702). GPAT4-8 contain a N-terminal region homologous to this domain SEQ ID NO:228 Conserved GPAT amino acid sequence GDLVICPEGTTCREP SEQ ID NO:229 Conserved GPAT/phosphatase amino acid sequence (Motif I)

SEQ ID NO:230 Conserved GPAT/phosphatase amino acid sequence (Motif III)

SEQ ID NO:231 *Arabidopsis thaliana* WRI1 polynucleotide (NM_202701.2)

SEQ ID NO:232 *Arabidopsis thaliana* WRI1 polynucleotide (NM_001035780.2)

SEQ ID NO:233 *Arabidopsis thaliana* WRI1 polynucleotide (NM_115292.4)

SEQ ID NO:234 *Arabidopsis lyrata* subsp. *lyrata* polynucleotide (XM_002876205.1)

SEQ ID NO:235 *Brassica napus* WRI1 polynucleotide (DQ370141.1)

SEQ ID NO:236 *Brassica napus* WRI1 polynucleotide (HM370542.1)

SEQ ID NO:237 *Glycine max* WRI1 polynucleotide (XM_003530322.1)

SEQ ID NO:238 *Jatropha curcas WRI*1 polynucleotide (JF703666.1)

SEQ ID NO:239 *Ricinus communis* WRI1 polynucleotide (XM_002525259.1)

SEQ ID NO:240 *Populus* trichocarpa WRI1 polynucleotide (XM_002316423.1)

SEQ ID NO:241 *Brachypodium distachyon WRI*1 polynucleotide (XM_003578949.1)

SEQ ID NO:242 *Hordeum vulgare* subsp. *vulgare* WRI1 polynucleotide (AK355408.1)

SEQ ID NO:243 *Sorghum bicolor* WRI1 polynucleotide (XM_002450149.1)

SEQ ID NO:244 *Zea mays* WRI1 polynucleotide (EU960249.1)

SEQ ID NO:245 *Brachypodium distachyon WRI*1 polynucleotide (XM_003561141.1)

SEQ ID NO:246 *Sorghum bicolor* WRI1 polynucleotide (XM_002437774.1)

SEQ ID NO:247 *Sorghum bicolor* WRI1 polynucleotide (XM_002441399.1)

SEQ ID NO:248 *Glycine max* WRI1 polynucleotide (XM_003530638.1)

SEQ ID NO:249 *Glycine max* WRI1 polynucleotide (XM_003553155.1)

SEQ ID NO:250 *Populus* trichocarpa WRI1 polynucleotide (XM_002315758.1)

SEQ ID NO:251 *Vitis vinifera* WRI1 polynucleotide (XM_002270113.1)

SEQ ID NO:252 *Glycine max* WRI1 polynucleotide (XM_003533500.1)

SEQ ID NO:253 *Glycine max* WRI1 polynucleotide (XM_003551675.1)

SEQ ID NO:254 *Medicago truncatula* WRI1 polynucleotide (XM_003621069.1)

SEQ ID NO:255 *Populus* trichocarpa WRI1 polynucleotide (XM_002323800.1)

SEQ ID NO:256 *Ricinus communis* WRI1 polynucleotide (XM_002517428.1)

SEQ ID NO:257 *Brachypodium distachyon WRI*1 polynucleotide (XM_003572188.1)

SEQ ID NO:258 *Sorghum bicolor* WRI1 polynucleotide (XM_002444384.1)

SEQ ID NO:259 *Zea mays* WRI1 polynucleotide (NM_001176888.1)

SEQ ID NO:260 *Arabidopsis lyrata* subsp. *lyrata* WRI1 polynucleotide (XM_002889219.1)

SEQ ID NO:261 *Arabidopsis thaliana* WRI1 polynucleotide (NM_106619.3)

SEQ ID NO:262 *Arabidopsis lyrata* subsp. *lyrata* WRI1 polynucleotide (XM_002890099.1)

SEQ ID NO:263 *Thellungiella halophila* WRI1 polynucleotide (AK352786.1)

SEQ ID NO:264 *Arabidopsis thaliana* WRI1 polynucleotide (NM_101474.2)

SEQ ID NO:265 *Glycine max* WRI1 polynucleotide (XM_003530302.1)

SEQ ID NO:266 *Brachypodium distachyon WRI*1 polynucleotide (XM_003578094.1)

SEQ ID NO:267 *Sorghum bicolor* WRI1 polynucleotide (XM_002460191.1)

SEQ ID NO:268 *Zea mays* WRI1 polynucleotide (NM_001152866.1)

SEQ ID NO:269 *Glycine max* WRI1 polynucleotide (XM_003519119.1)

SEQ ID NO:270 *Glycine max* WRI1 polynucleotide (XM_003550628.1)

SEQ ID NO:271 *Medicago truncatula* WRI1 polynucleotide (XM_003610213.1)

SEQ ID NO:272 *Glycine max* WRI1 polynucleotide (XM_003523982.1)

SEQ ID NO:273 *Glycine max* WRI1 polynucleotide (XM_003525901.1)

SEQ ID NO:274 *Populus* trichocarpa WRI1 polynucleotide (XM_002325075.1)

SEQ ID NO:275 *Vitis vinifera* WRI1 polynucleotide (XM_002273010.2)

SEQ ID NO:276 *Populus* trichocarpa WRI1 polynucleotide (XM_002303830.1)

SEQ ID NO:277 *Lupinis angustifolius* WRI1 polynucleotide, partial sequence (NA-080818_Plate14f06.b1)

SEQ ID NO:278 *Lupinis angustifolius* WRI1 polynucleotide

SEQ ID NO:279 *Arabidopsis thaliana* WRI1 polypeptide (A8MS57)

SEQ ID NO:280 *Arabidopsis thaliana* WRI1 polypeptide (Q6X5Y6)

SEQ ID NO:281 *Arabidopsis lyrata* subsp. *lyrata* WRI1 polypeptide (XP_002876251.1)

SEQ ID NO:282 *Brassica napus* WRI1 polypepetide (ABD16282.1)

SEQ ID NO:283 *Brassica napus* WRI1 polyppetide (ADO16346.1)

SEQ ID NO:284 *Glycine max* WRI1 polypeptide (XP_003530370.1)

SEQ ID NO:285 *Jatropha curcas WRI*1 polypeptide (AE022131.1)

SEQ ID NO:286 *Ricinus communis* WRI1 polypeptide (XP_002525305.1)

SEQ ID NO:287 *Populus* trichocarpa WRI1 polypeptide (XP_002316459.1)

SEQ ID NO:288 *Vitis vinifera* WRI1 polypeptide (CBI29147.3)

SEQ ID NO:289 *Brachypodium distachyon WRI*1 polypeptide (XP_003578997.1)

SEQ ID NO:290 *Hordeum vulgare* subsp. *vulgare* WRI1 polypeptide (BAJ86627.1)

SEQ ID NO:291 *Oryza sativa* WRI1 polypeptide (EAY79792.1)

SEQ ID NO:292 *Sorghum bicolor* WRI1 polypeptide (XP_002450194.1)

SEQ ID NO:293 *Zea mays* WRI1 polypeptide (ACG32367.1)
SEQ ID NO:294 *Brachypodium distachyon* WRI1 polypeptide (XP_003561189.1)
SEQ ID NO:295 *Brachypodium sylvaticum* WRI1 polypeptide (ABL85061.1)
SEQ ID NO:296 *Oryza sativa* WRI1 polypeptide (BAD68417.1)
SEQ ID NO:297 *Sorghum bicolor* WRI1 polypeptide (XP_002437819.1)
SEQ ID NO:298 *Sorghum bicolor* WRI1 polypeptide (XP_002441444.1)
SEQ ID NO:299 *Glycine max* WRI1 polypeptide (XP_003530686.1)
SEQ ID NO:300 *Glycine max* WRI1 polypeptide (XP_003553203.1)
SEQ ID NO:301 *Populus trichocarpa* WRI1 polypeptide (XP_002315794.1)
SEQ ID NO:302 *Vitis vinifera* WRI1 polypeptide (XP_002270149.1)
SEQ ID NO:303 *Glycine max* WRI1 polypeptide (XP_003533548.1)
SEQ ID NO:304 *Glycine max* WRI1 polypeptide (XP_003551723.1)
SEQ ID NO:305 *Medicago truncatula* WRI1 polypeptide (XP_003621117.1)
SEQ ID NO:306 *Populus trichocarpa* WRI1 polypeptide (XP_002323836.1)
SEQ ID NO:307 *Ricinus communis* WRI1 polypeptide (XP_002517474.1)
SEQ ID NO:308 *Vitis vinifera* WRI1 polypeptide (CAN79925.1)
SEQ ID NO:309 *Brachypodium distachyon* WRI1 polypeptide (XP_003572236.1)
SEQ ID NO:310 *Oryza sativa* WRI1 polypeptide (BAD10030.1)
SEQ ID NO:311 *Sorghum bicolor* WRI1 polypeptide (XP_002444429.1)
SEQ ID NO:312 *Zea mays* WRI1 polypeptide (NP_001170359.1)
SEQ ID NO:313 *Arabidopsis lyrata* subsp. *lyrata* WRI1 polypeptide (XP_002889265.1)
SEQ ID NO:314 *Arabidopsis thaliana* WRI1 polypeptide (AAF68121.1)
SEQ ID NO:315 *Arabidopsis thaliana* WRI1 polypeptide (NP_178088.2)
SEQ ID NO:316 *Arabidopsis lyrata* subsp. *lyrata* WRI1 polypeptide (XP_002890145.1)
SEQ ID NO:317 *Thellungiella halophila* WRI1 polypeptide (BAJ33872.1)
SEQ ID NO:318 *Arabidopsis thaliana* WRI1 polypeptide (NP_563990.1)
SEQ ID NO:319 *Glycine max* WRI1 polypeptide (XP_003530350.1)
SEQ ID NO:320 *Brachypodium distachyon* WRI1 polypeptide (XP_003578142.1)
SEQ ID NO:321 *Oryza sativa* WRI1 polypeptide (EAZ09147.1)
SEQ ID NO:322 *Sorghum bicolor* WRI1 polypeptide (XP_002460236.1)
SEQ ID NO:323 *Zea mays* WRI1 polypeptide (NP_001146338.1)
SEQ ID NO:324 *Glycine max* WRI1 polypeptide (XP_003519167.1)
SEQ ID NO:325 *Glycine max* WRI1 polypeptide (XP_003550676.1)
SEQ ID NO:326 *Medicago truncatula* WRI1 polypeptide (XP_003610261.1)
SEQ ID NO:327 *Glycine max* WRI1 polypeptide (XP_003524030.1)
SEQ ID NO:328 *Glycine max* WRI1 polypeptide (XP_003525949.1)
SEQ ID NO:329 *Populus trichocarpa* WRI1 polypeptide (XP_002325111.1)
SEQ ID NO:330 *Vitis vinifera* WRI1 polypeptide (CBI36586.3)
SEQ ID NO:331 *Vitis vinifera* WRI1 polypeptide (XP_002273046.2)
SEQ ID NO:332 *Populus trichocarpa* WRI1 polypeptide (XP_002303866.1)
SEQ ID NO:333 *Vitis vinifera* WRI1 polypeptide (CBI25261.3)
SEQ ID NO:334 Sorbi-WRL1
SEQ ID NO: 335 Lupan-WRL1
SEQ ID NO:336 Ricco-WRL1
SEQ ID NO:337 *Lupin angustifolius* WRI1 polypeptide
SEQ ID NO:338 *Aspergillus fumigatus* DGAT polynucleotide (XM_750079.1)
SEQ ID NO:339 *Ricinus communis* DGAT polynucleotide (AY366496.1)
SEQ ID NO:340 *Vernicia fordii* DGAT1 polynucleotide (DQ356680.1)
SEQ ID NO:341 *Vernonia galamensis* DGAT1 polynucleotide (EF653276.1)
SEQ ID NO:342 *Vernonia galamensis* DGAT1 polynucleotide (EF653277.1)
SEQ ID NO:343 *Euonymus alatus* DGAT1 polynucleotide (AY751297.1)
SEQ ID NO:344 *Caenorhabditis elegans* DGAT1 polynucleotide (AF221132.1)
SEQ ID NO:345 *Rattus norvegicus* DGAT1 polynucleotide (NM_053437.1)
SEQ ID NO:346 *Homo sapiens* DGAT 1 polynucleotide (NM_012079.4)
SEQ ID NO:347 *Aspergillus fumigatus* DGAT1 polypeptide (XP_755172.1)
SEQ ID NO:348 *Ricinus communis* DGAT1 polypeptide (AAR11479.1)
SEQ ID NO:349 *Vernicia fordii* DGAT1 polypeptide (ABC94472.1)
SEQ ID NO:350 *Vernonia galamensis* DGAT1 polypeptide (ABV21945.1)
SEQ ID NO:351 *Vernonia galamensis* DGAT1 polypeptide (ABV21946.1)
SEQ ID NO:352 *Euonymus alatus* DGAT1 polypeptide (AAV31083.1)
SEQ ID NO:353 *Caenorhabditis elegans* DGAT1 polypeptide (AAF82410.1)
SEQ ID NO:354 *Rattus norvegicus* DGAT1 polypeptide (NP_445889.1)
SEQ ID NO:355 *Homo sapiens* DGAT1 polypeptide (NP_036211.2)
SEQ ID NO:356 WRI1 motif (R G V T/S R H R W T G R)
SEQ ID NO:357 WRI1 motif (F/Y E A H L W D K)
SEQ ID NO:358 WRI1 motif (D L A A L K Y W G)
SEQ ID NO:359 WRI1 motif (S X G F S/A R G X)
SEQ ID NO:360 WRI1 motif (H H H/Q N G R/K W E A R I G R/K V)
SEQ ID NO:361 WRI1 motif (Q E E A A A X Y D)
SEQ ID NO:362 *Brassica napus* oleosin polypeptide (CAA57545.1)
SEQ ID NO:363 *Brassica napus* oleosin S1-1 polypeptide (ACG69504.1)

SEQ ID NO:364 *Brassica napus* oleosin S2-1 polypeptide (ACG69503.1)
SEQ ID NO:365 *Brassica napus* oleosin S3-1 polypeptide (ACG69513.1)
SEQ ID NO:366 *Brassica napus* oleosin S4-1 polypeptide (ACG69507.1)
SEQ ID NO:367 *Brassica napus* oleosin S5-1 polypeptide (ACG69511.1)
SEQ ID NO:368 *Arachis hypogaea* oleosin 1 polypeptide (AAZ20276.1)
SEQ ID NO:369 *Arachis hypogaea* oleosin 2 polypeptide (AAU21500.1)
SEQ ID NO:370 *Arachis hypogaea* oleosin 3 polypeptide (AAU21501.1)
SEQ ID NO:371 *Arachis hypogaea* oleosin 5 polypeptide (ABC96763.1)
SEQ ID NO:372 *Ricinus communis* oleosin 1 polypeptide (EEF40948.1)
SEQ ID NO:373 *Ricinus communis* oleosin 2 polypeptide (EEF51616.1)
SEQ ID NO:374 *Glycine max* oleosin isoform a polypeptide (P29530.2)
SEQ ID NO:375 *Glycine max* oleosin isoform b polypeptide (P29531.1)
SEQ ID NO:376 *Linum usitatissimum* oleosin low molecular weight isoform polypeptide (ABB01622.1)
SEQ ID NO:377 amino acid sequence of *Linum usitatissimum* oleosin high molecular weight isoform polypeptide (ABB01624.1)
SEQ ID NO:378 *Helianthus annuus* oleosin polypeptide (CAA44224.1)
SEQ ID NO:379 *Zea mays* oleosin polypeptide (NP_001105338.1)
SEQ ID NO:380 *Brassica napus* steroleosin polypeptide (ABM30178.1)
SEQ ID NO:381 *Brassica napus* steroleosin SLO1-1 polypeptide (ACG69522.1)
SEQ ID NO:382 *Brassica napus* steroleosin SLO2-1 polypeptide (ACG69525.1)
SEQ ID NO:383 *Sesamum indicum* steroleosin polypeptide (AAL13315.1)
SEQ ID NO:384 *Zea mays* steroleosin polypeptide (NP_001152614.1)
SEQ ID NO:385 *Brassica napus* caleosin CLO-1 polypeptide (ACG69529.1)
SEQ ID NO:386 *Brassica napus* caleosin CLO-3 polypeptide (ACG69527.1)
SEQ ID NO:387 *Sesamum indicum* caleosin polypeptide (AAF13743.1)
SEQ ID NO:388 *Zea mays* caleosin polypeptide (NP_001151906.1)
SEQ ID NO:389 *Brassica napus* oleosin polynucleotide (X82020.1)
SEQ ID NO:390 *Brassica napus* oleosin S1-1 polynucleotide (EU678256.1)
SEQ ID NO:391 *Brassica napus* oleosin S2-1 polynucleotide (EU678255.1)
SEQ ID NO:392 *Brassica napus* oleosin S3-1 polynucleotide (EU678265.1)
SEQ ID NO:393 *Brassica napus* oleosin S4-1 polynucleotide (EU678259.1)
SEQ ID NO:394 *Brassica napus* oleosin S5-1 polynucleotide (EU678263.1)
SEQ ID NO:395 *Arachis hypogaea* oleosin 1 polynucleotide (DQ097716.1)
SEQ ID NO:396 *Arachis hypogaea* oleosin 2 polynucleotide (AY722695.1)
SEQ ID NO:397 *Arachis hypogaea* oleosin 3 polynucleotide (AY722696.1)
SEQ ID NO:398 *Arachis hypogaea* oleosin 5 polynucleotide (DQ368496.1)
SEQ ID NO:399 *Helianthus annuus* oleosin polynucleotide (X62352.1)
SEQ ID NO:400 *Zea mays* oleosin polynucleotide (NM_001111868.1)
SEQ ID NO:401 *Brassica napus* steroleosin polynucleotide (EF143915.1)
SEQ ID NO:402 *Brassica napus* steroleosin SLO1-1 polynucleotide (EU678274.1)
SEQ ID NO:403 *Brassica napus* steroleosin SLO2-1 polynucleotide (EU678277.1)
SEQ ID NO:404 *Zea mays* steroleosin polynucleotide (NM_001159142.1)
SEQ ID NO:405 *Brassica napus* caleosin CLO-1 polynucleotide (EU678281.1)
SEQ ID NO:406 *Brassica napus* caleosin CLO-3 polynucleotide (EU678279.1)
SEQ ID NO:407 *Sesamum indicum* caleosin polynucleotide (AF109921.1)
SEQ ID NO:408 *Zea mays* caleosin polynucleotide (NM_001158434.1)
SEQ ID NO:409 pJP3502 entire vector sequence (three-gene)
SEQ ID NO:410 pJP3503 entire vector sequence (four-gene)
SEQ ID NO:411 pJP3502 TDNA (inserted into genome) sequence
sEQ ID NO:412 pJP3503 TDNA (inserted into genome) sequence
SEQ ID NO:413 pJP3507 vector sequence
SEQ ID NO:414 Linker sequence
SEQ ID NO:415 Soybean Synergy
SEQ ID NO:416 12ABFJYC_pJP3569_insert
SEQ ID NO:417 Partial *N. benthamiana* CGI-58 sequence selected for hpRNAi silencing (pTV46)
SEQ ID NO:418 Partial *N. tabacum* AGPase sequence selected for hpRNAi silencing (pTV35)
SEQ ID NO:419 GXSXG lipase motif
SEQ ID NO:420 HX(4)D acyltransferase motif
SEQ ID NO:421 VX(3)HGF probable lipid binding motif
SEQ ID NO:422 *Arabidopsis thaliana* CGi58 polynucleotide (NM_118548.1)
SEQ ID NO:423: *Brachypodium distachyon* CGi58 polynucleotide (XM_003578402.1)
SEQ ID NO:424 *Glycine max* CGi58 polynucleotide (XM_003523590.1)
SEQ ID NO:425 *Zea mays* CGi58 polynucleotide (NM_001155541.1)
SEQ ID NO:426 *Sorghum bicolor* CGi58 polynucleotide (XM_002460493.1)
SEQ ID NO:427 *Ricinus communis* CGi58 polynucleotide (XM_002510439.1)
SEQ ID NO:428 *Medicago truncatula* CGi58 polynucleotide (XM_003603685.1)
SEQ ID NO:429 *Arabidopsis thaliana* CGi58 polypeptide (NP_194147.2)
SEQ ID NO:430 *Brachypodium distachyon* CGi58 polypeptide (XP_003578450.1)
SEQ ID NO:431 *Glycine max* CGi58 polypeptide (XP_003523638.1)
SEQ ID NO:432 *Zea Mays* CGi58 polypeptide (NP_001149013.1)
SEQ ID NO:433 *Sorghum bicolor* CGi58 polypeptide (XP_002460538.1)

SEQ ID NO:434 *Ricinus communis* CGi58 polypeptide (XP_002510485.1)
SEQ ID NO:435 *Medicago truncatula* CGi58 polypeptide (XP_003603733.1)
SEQ ID NO:436 *Oryza sativa* CGi58 polypeptide (EAZ09782.1)
SEQ ID NO:437 *Arabidopsis thaliana* LEC2 polynucleotide (NM_102595.2)
SEQ ID NO:438 *Medicago truncatula* LEC2 polynucleotide (X60387.1)
SEQ ID NO:439 *Brassica napus* LEC2 polynucleotide (HM370539.1)
SEQ ID NO:440 *Arabidopsis thaliana* BBM polynucleotide (NM_121749.2)
SEQ ID NO:441 *Medicago truncatula* BBM polynucleotide (AY899909.1)
SEQ ID NO:442 *Arabidopsis thaliana* LEC2 polypeptide (NP_564304.1)
SEQ ID NO:443 *Medicago truncatula* LEC2 polypeptide (CAA42938.1)
SEQ ID NO:444 *Brassica napus* LEC2 polypeptide (ADO16343.1)
SEQ ID NO:445 *Arabidopsis thaliana* BBM polypeptide (NP_197245.2)
SEQ ID NO:446 *Medicago truncatula* BBM polypeptide (AAW82334.1)
SEQ ID NO:447 Inducible *Aspergilus niger* alcA promoter
SEQ ID NO:448 AlcR inducer that activates the AlcA promotor in the presence of ethanol

DETAILED DESCRIPTION OF THE INVENTION

General Techniques and Definitions

Unless specifically defined otherwise, all technical and scientific terms used herein shall be taken to have the same meaning as commonly understood by one of ordinary skill in the art (e.g., in cell culture, molecular genetics, immunology, immunohistochemistry, protein chemistry, lipid and fatty acid chemistry, biofeul production, and biochemistry).

Unless otherwise indicated, the recombinant protein, cell culture, and immunological techniques utilized in the present invention are standard procedures, well known to those skilled in the art. Such techniques are described and explained throughout the literature in sources such as, J. Perbal, A Practical Guide to Molecular Cloning, John Wiley and Sons (1984), J. Sambrook et al., Molecular Cloning: A Laboratory Manual, Cold Spring Harbour Laboratory Press (1989), T. A. Brown (editor), Essential Molecular Biology: A Practical Approach, Volumes 1 and 2, IRL Press (1991), D. M. Glover and B. D. Hames (editors), DNA Cloning: A Practical Approach, Volumes 1-4, IRL Press (1995 and 1996), F. M. Ausubel et al. (editors), Current Protocols in Molecular Biology, Greene Pub. Associates and Wiley-Interscience (1988, including all updates until present), Ed Harlow and David Lane (editors) Antibodies: A Laboratory Manual, Cold Spring Harbour Laboratory, (1988), and J. E. Coligan et al. (editors) Current Protocols in Immunology, John Wiley & Sons (including all updates until present).

Selected Definitions

The term "transgenic non-human organism" refers to, for example, a whole plant, alga, non-human animal, or an organism suitable for fermentation such as a yeast or fungus, comprising an exogenous polynucleotide (transgene) or an exogenous polypeptide. In an embodiment, the transgenic non-human organism is not an animal or part thereof. In one embodiment, the transgenic non-human organism is a phototrophic organism (for example, a plant or alga) capable of obtaining energy from sunlight to synthesize organic compounds for nutrition. In another embodiment, the transgenic non-human organism is a photosynthetic bacterium.

The term "exogenous" in the context of a polynucleotide or polypeptide refers to the polynucleotide or polypeptide when present in a cell which does not naturally comprise the polynucleotide or polypeptide. Such a cell is referred to herein as a "recombinant cell" or a "transgenic cell". In an embodiment, the exogenous polynucleotide or polypeptide is from a different genus to the cell comprising the exogenous polynucleotide or polypeptide. In another embodiment, the exogenous polynucleotide or polypeptide is from a different species. In one embodiment the exogenous polynucleotide or polypeptide is expressed in a host plant or plant cell and the exogenous polynucleotide or polypeptide is from a different species or genus. The exogenous polynucleotide or polypeptide may be non-naturally occurring, such as for example, a synthetic DNA molecule which has been produced by recombinant DNA methods. The DNA molecule may, often preferably, include a protein coding region which has been codon-optimised for expression in the cell, thereby producing a polypeptide which has the same amino acid sequence as a naturally occurring polypeptide, even though the nucleotide sequence of the protein coding region is non-naturally occurring. The exogenous polynucleotide may encode, or the exogenous polypeptide may be: a diacylglycerol acyltransferase (DGAT) such as a DGAT1 or a DGAT2, a glycerol-3-phosphate acyltransferase (GPAT) such as a GPAT which is capable of synthesising MAG, a Wrinkled 1 (WRI1) transcription factor, an Oleosin, or a silencing suppressor polypeptide. In one embodiment, the exogenous polypeptide is an exogenous MGAT such as an MGAT1 or an MGAT2.

As used herein, the term "extracted lipid" refers to a composition extracted from a transgenic organism or part thereof which comprises at least 60% (w/w) lipid.

As used herein, the term "non-polar lipid" refers to fatty acids and derivatives thereof which are soluble in organic solvents but insoluble in water. The fatty acids may be free fatty acids and/or in an esterified form. Examples of esterified forms include, but are not limited to, triacylglycerol (TAG), diacylglycerol (DAG), monoacylglycerol (MAG). Non-polar lipids also include sterols, sterol esters and wax esters. Non-polar lipids are also known as "neutral lipids". Non-polar lipid is typically a liquid at room temperature. Preferably, the non-polar lipid predominantly (>50%) comprises fatty acids that are at least 16 carbons in length. More preferably, at least 50% of the total fatty acids in the non-polar lipid are C18 fatty acids for example, oleic acid. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in non-polar lipid of the invention can be found as TAG. The non-polar lipid may be further purified or treated, for example by hydrolysis with a strong base to release the free fatty acid, or by fractionation, distillation, or the like. Non-polar lipid may be present in or obtained from plant parts such as seed, leaves or fruit, from recombinant cells or from non-human organisms such as yeast. Non-polar lipid of the invention may form part of "seedoil" if it is obtained from seed. The free and esterified sterol (for example, sitosterol, campesterol, stigmasterol, brassicasterol, 45-avenasterol, sitostanol, campestanol, and cholesterol) concentrations in the extracted lipid may be as described in Phillips et al., 2002. Sterols in plant oils are present as free alcohols, esters with fatty acids (esterified sterols), glycosides and acylated glycosides of sterols. Sterol concentrations in naturally occurring vegetable oils (seedoils) ranges up to a maximum of about 1100 mg/100 g. Hydrogenated palm oil has one of the lowest concentrations of naturally occurring vegetable oils at about 60 mg/100 g. The recovered or extracted seedoils of the invention preferably have between about 100 and about 1000 mg total sterol/100 g of oil. For use as food or feed, it is preferred that sterols are present primarily as free or esterified forms rather than glycosylated forms. In the seedoils of the present invention, preferably at least 50% of the sterols in the oils are present as esterified sterols, except for soybean seedoil which has about 25% of the sterols esterified. The canola seedoil and rapeseed oil of the invention preferably have between about 500 and about 800 mg total sterol/100 g, with sitosterol the main sterol and campesterol the next most abundant. The corn seedoil of the invention preferably has between about 600 and about 800 mg total sterol/100 g, with sitosterol the main sterol. The soybean seedoil of the invention preferably has between about 150 and about 350 mg total sterol/100 g, with sitosterol the main sterol and stigmasterol the next most abundant, and with more free sterol than esterified sterol. The cottonseed oil of the invention preferably has between about 200 and about 350 mg total sterol/100 g, with sitosterol the main sterol. The coconut oil and palm oil of the invention preferably have between about 50 and about 100 mg total sterol/100 g, with sitosterol the main sterol. The safflower seedoil of the invention preferably has between about 150 and about 250 mg total sterol/100 g, with sitosterol the main sterol. The peanut seedoil of the invention preferably has between about 100 and about 200 mg total sterol/100 g, with sitosterol the main sterol. The sesame seedoil of the invention preferably has between about 400 and about 600 mg total sterol/100 g, with sitosterol the main sterol. The sunflower seedoil of the invention preferably has between about 200 and 400 mg total sterol/100 g, with sitosterol the main sterol. Oils obtained from vegetative plant parts according to the invention preferably have less than 200 mg total sterol/100 g, more preferably less than 100 mg total sterol/100 g, and most preferably less than 50 mg total sterols/100 g, with the majority of the sterols being free sterols.

As used herein, the term "seedoil" refers to a composition obtained from the seed/grain of a plant which comprises at least 60% (w/w) lipid, or obtainable from the seed/grain if the seedoil is still present in the seed/grain. That is, seedoil of the invention includes seedoil which is present in the seed/grain or portion thereof, as well as seedoil which has been extracted from the seed/grain. The seedoil is preferably extracted seedoil. Seedoil is typically a liquid at room temperature. Preferably, the total fatty acid (TFA) content in the seedoil predominantly (>50%) comprises fatty acids that are at least 16 carbons in length. More preferably, at least 50% of the total fatty acids in the seedoil are C18 fatty acids for example, oleic acid. The fatty acids are typically in an esterified form such as for example, TAG, DAG, acyl-CoA or phospholipid. The fatty acids may be free fatty acids and/or in an esterified form. In an embodiment, at least 50%, more preferably at least 70%, more preferably at least 80%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99% of the fatty acids in seedoil of the invention can be found as TAG. In an embodiment, seedoil of the invention is "substantially purified" or "purified" oil that has been separated from one or more other lipids, nucleic acids, polypeptides, or other contaminating molecules with which it is associated in the seed or in a crude extract. It is preferred that the substantially purified seedoil is at least 60% free, more preferably at least 75% free, and more preferably, at least 90% free from other components with which it is associated in the seed or extract. Seedoil of the invention may further comprise non-fatty acid molecules such as, but not limited to, sterols. In an embodiment, the seedoil is canola oil (*Brassica* sp. such as *Brassica carinata*, *Brassica juncea*, *Brassica napobrassica*, *Brassica napus*) mustard oil (*Brassica juncea*), other *Brassica* oil (e.g., *Brassica napobrassica*, *Brassica camelina*), sunflower oil (*Helianthus* sp. such as *Helianthus annuus*), linseed oil (*Linum usitatissimum*), soybean oil (*Glycine max*), safflower oil (*Carthamus tinctorius*), corn oil (*Zea mays*), tobacco oil (*Nicotiana* sp. such as *Nicotiana tabacum* or *Nicotiana benthamiana*), peanut oil (*Arachis hypogaea*), palm oil (*Elaeis guineensis*), cottonseed oil (*Gossypium hirsutum*), coconut oil (*Cocos nucifera*), avocado oil (*Persea americana*), olive oil (*Olea europaea*), cashew oil (*Anacardium occidentale*), macadamia oil (*Macadamia intergrifolia*), almond oil (*Prunus amygdalus*), oat seed oil (*Avena sativa*), rice oil (*Oryza* sp. such as *Oryza sativa* and *Oryza glaberrima*), *Arabidopsis* seed oil (*Arabidopsis thaliana*), or oil from the seed of *Acrocomia aculeata* (macauba palm), *Aracinis hypogaea* (peanut), *Astrocaryum murumuru* (murumuru), *Astrocaryum vulgare* (tucumã), *Attalea geraensis* (Indaiá-rateiro), *Attalea humilis* (American oil palm), *Attalea oleifera* (andaiá), *Attalea phalerata* (uricuri), *Attalea speciosa* (babassu), *Beta vulgaris* (sugar beet), *Camelina sativa* (false flax), *Caryocar brasiliense* (pequi), *Crambe abyssinica* (Abyssinian kale), *Cucumis melo* (melon), *Hordeum vulgare* (barley), *Jatropha curcas* (physic nut), *Joannesia princeps* (arara nut-tree), *Licania rigida* (oiticica), *Lupinus angustifolius* (lupin), *Mauritia flexuosa* (buriti palm), *Maximiliana maripa* (inaja palm), *Miscanthus* sp. such as *Miscanthus×giganteus* and *Miscanthus sinensis*, *Oenocarpus bacaba* (bacaba-do-azeite), *Oenocarpus bataua* (patauã), *Oenocarpus distichus* (bacaba-de-leque), *Panicum virgatum* (switchgrass), *Paraqueiba paraensis* (mari), *Persea amencana* (avocado), *Pongamia pinnata* (Indian beech), *Populus trichocarpa*, *Ricinus communis* (castor), *Saccharum* sp. (sugarcane), *Sesamum indicum* (sesame), *Solanum tuberosum* (potato), *Sorghum* sp. such as *Sorghum bicolor*, *Sorghum vulgare*, *Theobroma grandiforum* (cupuassu), *Trifolium* sp., *Trithrinax brasiliensis* (Brazilian needle palm) and *Triticum* sp. (wheat) such as *Triticum aestivum*. Seedoil may be extracted from seed/grain by any method known in the art. This typically involves extraction with nonpolar solvents such as diethyl ether, petroleum ether, chloroform/methanol or butanol mixtures, generally associated with first crushing of the seeds. Lipids associated with the starch in the grain may be extracted with water-saturated butanol. The seedoil may be "de-gummed" by methods known in the art to remove polysaccharides or treated in other ways to remove contaminants or improve purity, stability, or colour. The TAGs and other esters in the seedoil may be hydrolysed to release free fatty acids, or the seedoil hydrogenated, treated chemically, or enzymatically as known in the art.

As used herein, the term "fatty acid" refers to a carboxylic acid with a long aliphatic tail of at least 8 carbon atoms in length, either saturated or unsaturated. Typically, fatty acids have a carbon-carbon bonded chain of at least 12 carbons in length. Most naturally occurring fatty acids have an even number of carbon atoms because their biosynthesis involves acetate which has two carbon atoms. The fatty acids may be in a free state (non-esterified) or in an esterified form such as part of a TAG, DAG, MAG, acyl-CoA (thio-ester) bound, or other covalently bound form. When covalently bound in an esterified form, the fatty acid is referred to herein as an "acyl" group. The fatty acid may be esterified as a phospholipid such as a phosphatidylcholine (PC), phosphatidylethanolamine, phosphatidylserine, phosphatidylglycerol, phosphatidylinositol, or diphosphatidylglycerol. Saturated fatty acids do not contain any double bonds or other functional groups along the chain. The term "saturated" refers to hydrogen, in that all carbons (apart from the carboxylic acid [—COOH] group) contain as many hydrogens as possible. In other words, the omega (ω) end contains 3 hydrogens (CH3-) and each carbon within the chain contains 2 hydrogens (—CH2-). Unsaturated fatty acids are of similar form to saturated fatty acids, except that one or more alkene functional groups exist along the chain, with each alkene substituting a singly-bonded "—CH2-CH2-" part of the chain with a doubly-bonded "—CH=CH—" portion (that is, a carbon double bonded to another carbon). The two next carbon atoms in the chain that are bound to either side of the double bond can occur in a cis or trans configuration.

As used herein, the terms "polyunsaturated fatty acid" or "PUFA" refer to a fatty acid which comprises at least 12 carbon atoms in its carbon chain and at least two alkene groups (carbon-carbon double bonds). The PUFA content of the vegetative plant part, or the non-human organism or part thereof of the invention may be increased or decreased depending on the combination of exogenous polynucleotides expressed in the vegetative plant part, or non-human organism or part thereof, or seed of the invention. For example, when an MGAT is expressed the PUFA level typically increases, whereas when DGAT1 is expressed alone or in combination with WRI1, the PUFA level is typically decreased due to an increase in the level of oleic acid. Furthermore, if Δ12 desaturase activity is reduced, for example by silencing an endogenous Δ12 desaturase, PUFA content is unlikely to increase in the absence of an exogenous polynucleotide encoding a different Δ12 desaturase.

"Monoacylglyceride" or "MAG" is glyceride in which the glycerol is esterified with one fatty acid. As used herein, MAG comprises a hydroxyl group at an sn-1/3 (also referred to herein as sn-1 MAG or 1-MAG or 1/3-MAG) or sn-2 position (also referred to herein as 2-MAG), and therefore MAG does not include phosphorylated molecules such as PA or PC. MAG is thus a component of neutral lipids in a cell.

"Diacylglyceride" or "DAG" is glyceride in which the glycerol is esterified with two fatty acids which may be the same or, preferably, different. As used herein, DAG comprises a hydroxyl group at a sn-1,3 or sn-2 position, and therefore DAG does not include phosphorylated molecules such as PA or PC. DAG is thus a component of neutral lipids in a cell. In the Kennedy pathway of DAG synthesis (FIG. 1), the precursor sn-glycerol-3-phosphate (G-3-P) is esterified to two acyl groups, each coming from a fatty acid coenzyme A ester, in a first reaction catalysed by a glycerol-3-phosphate acyltransferase (GPAT) at position sn-1 to form LysoPA, followed by a second acylation at position sn-2 catalysed by a lysophosphatidic acid acyltransferase (LPAAT) to form phosphatidic acid (PA). This intermediate is then de-phosphorylated to form DAG. In an alternative anabolic pathway (FIG. 1), DAG may be formed by the acylation of either sn-1 MAG or preferably sn-2 MAG, catalysed by MGAT. DAG may also be formed from TAG by removal of an acyl group by a lipase, or from PC essentially by removal of a choline headgroup by any of the enzymes CPT, PDCT or PLC (FIG. 1).

"Triacylglyceride" or "TAG" is glyceride in which the glycerol is esterified with three fatty acids which may be the same (e.g. as in tri-olein) or, more commonly, different. In the Kennedy pathway of TAG synthesis, DAG is formed as described above, and then a third acyl group is esterified to the glycerol backbone by the activity of DGAT. Alternative pathways for formation of TAG include one catalysed by the enzyme PDAT and the MGAT pathway described herein.

As used herein, the term "acyltransferase" refers to a protein which is capable of transferring an acyl group from acyl-CoA onto a substrate and includes MGATs, GPATs and DGATs.

As used herein, the term "Wrinkled 1" or "WRI1" or "WRL1" refers to a transcription factor of the AP2/ERWEBP class which regulates the expression of several enzymes involved in glycolysis and de novo fatty acid biosynthesis. WRI1 has two plant-specific (AP2/EREB) DNA-binding domains. WRI1 in at least *Arabidopsis* also regulates the breakdown of sucrose via glycolysis thereby regulating the supply of precursors for fatty acid biosynthesis. In other words, it controls the carbon flow from the photosynthate to storage lipids. wri1 mutants have wrinkled seed phenotype, due to a defect in the incorporation of sucrose and glucose into TAGs.

Examples of genes which are transcribed by WRI1 include, but are not limited to, one or more, preferably all, of pyruvate kinase (At5g52920, At3g22960), pyruvate dehydrogenase (PDH) E1alpha subunit (At1g01090), acetyl-CoA carboxylase (ACCase), BCCP2 subunit (At5g15530), enoyl-ACP reductase (At2g05990; EAR), phosphoglycerate mutase (At1g22170), cytosolic fructokinase, and cytosolic phosphoglycerate mutase, sucrose synthase (SuSy) (see, for example, Liu et al., 2010b; Baud et al., 2007; Ruuska et al., 2002).

WRL1 contains the conserved domain AP2 (cd00018). AP2 is a DNA-binding domain found in transcription regulators in plants such as APETALA2 and EREBP (ethylene responsive element binding protein). In EREBPs the domain specifically binds to the 11 bp GCC box of the ethylene response element (ERE), a promotor element essential for ethylene responsiveness. EREBPs and the C-repeat binding factor CBF1, which is involved in stress response, contain a single copy of the AP2 domain. APETALA2-like proteins, which play a role in plant development contain two copies.

Other sequence motifs in WRI1 and its functional homologs include:

```
                                       (SEQ ID NO: 356)
1. R G V T/S R H R W T G R.

(SEQ ID NO: 357)
2. F/Y E A H L W D K.

(SEQ ID NO: 358)
3. D L A A L K Y W G.

(SEQ ID NO: 359)
4. S X G F S/A R G X.

(SEQ ID NO: 360)
5. H H H/Q N G R/K W E A R I G R/K V.

(SEQ ID NO: 361)
6. Q E E A A A X Y D.
```

As used herein, the term "Wrinkled 1" or "WRI1" also includes "Wrinkled 1-like" or "WRI1-like" proteins. Examples of WRI1 proteins include Accession Nos: Q6X5Y6, (*Arabidopsis thaliana*; SEQ ID NO:280), XP_002876251.1 (*Arabidopsis lyrata* subsp. *Lyrata*; SEQ ID NO:281), ABD16282.1 (*Brassica napus*; SEQ ID NO:282), ADO16346.1 (*Brassica napus*; SEQ ID NO:283), XP_003530370.1 (*Glycine max*; SEQ ID NO:284), AE022131.1 (*Jatropha curcas*; SEQ ID NO:285), XP_002525305.1 (*Ricinus communis*; SEQ ID NO:286), XP_002316459.1 (*Populus trichocarpa*; SEQ ID NO:287), CBI29147.3 (*Vitis vinifera*; SEQ ID NO:288), XP_003578997.1 (*Brachypodium distachyon*; SEQ ID NO:289), BAJ86627.1 (*Hordeum vulgare* subsp. *vulgare*; SEQ ID NO:290), EAY79792.1 (*Oryza sativa*; SEQ ID NO:291), XP_002450194.1 (*Sorghum bicolor*; SEQ ID NO:292), ACG32367.1 (*Zea mays*; SEQ ID NO:293), XP_003561189.1 (*Brachypodium distachyon*; SEQ ID NO:294), ABL85061.1 (*Brachypodium sylvaticum*; SEQ ID NO:295), BAD68417.1 (*Oryza sativa*; SEQ ID NO:296), XP_002437819.1 (*Sorghum bicolor*; SEQ ID NO:297), XP_002441444.1 (*Sorghum bicolor*; SEQ ID NO:298), XP_003530686.1 (*Glycine max*; SEQ ID NO:299), XP_003553203.1 (*Glycine max*; SEQ ID NO:300), XP_002315794.1 (*Populus trichocarpa*; SEQ ID NO:301), XP_002270149.1 (*Vitis vinifera*; SEQ ID NO:302), XP_003533548.1 (*Glycine max*; SEQ ID NO:303), XP_003551723.1 (*Glycine max*; SEQ ID NO:304), XP_003621117.1 (*Medicago truncatula*; SEQ ID NO:305), XP_002323836.1 (*Populus trichocarpa*; SEQ ID NO:306), XP_002517474.1 (*Ricinus communis*; SEQ ID NO:307), CAN79925.1 (*Vitis vinifera*; SEQ ID NO:308), XP_003572236.1 (*Brachypodium distachyon*; SEQ ID NO:309), BAD10030.1 (*Oryza sativa*; SEQ ID NO:310), XP_002444429.1 (*Sorghum bicolor*; SEQ ID NO:311), NP_001170359.1 (*Zea mays*; SEQ ID NO:312), XP_002889265.1 (*Arabidopsis lyrata* subsp. *lyrata*; SEQ ID NO:313), AAF68121.1 (*Arabidopsis thaliana*; SEQ ID NO:314), NP_178088.2 (*Arabidopsis thaliana*; SEQ ID NO:315), XP_002890145.1 (*Arabidopsis lyrata* subsp. *lyrata*; SEQ ID NO:316), BAJ33872.1 (*Thellungiella halophila*; SEQ ID NO:317), NP_563990.1 (*Arabidopsis thaliana*; SEQ ID NO:318), XP_003530350.1 (*Glycine max*; SEQ ID NO:319), XP_003578142.1 (*Brachypodium distachyon*; SEQ ID NO:320), EAZ09147.1 (*Oryza sativa*; SEQ ID NO:321), XP_002460236.1 (*Sorghum bicolor*; SEQ ID NO:322), NP_001146338.1 (*Zea mays*; SEQ ID NO:323), XP_003519167.1 (*Glycine max*; SEQ ID NO:324), XP_003550676.1 (*Glycine max*; SEQ ID NO:325), XP_003610261.1 (*Medicago truncatula*; SEQ ID NO:326), XP_003524030.1 (*Glycine max*; SEQ ID NO:327), XP_003525949.1 (*Glycine max*; SEQ ID NO:328), XP_002325111.1 (*Populus trichocarpa*; SEQ ID NO:329), CBI36586.3 (*Vitis vinifera*; SEQ ID NO:330), XP_002273046.2 (*Vitis vinifera*; SEQ ID NO:331), XP_002303866.1 (*Populus trichocarpa*; SEQ ID NO:332), and CBI25261.3 (*Vitis vinifera*; SEQ ID NO:333). Further examples include Sorbi-WRL1 (SEQ ID NO:334), Lupan-WRL1 (SEQ ID NO:335), Ricco-WRL1 (SEQ ID NO:336), and *Lupin angustifolius* WRI1 (SEQ ID NO:337).

As used herein, the term "monoacylglycerol acyltransferase" or "MGAT" refers to a protein which transfers a fatty acyl group from acyl-CoA to a MAG substrate to produce DAG. Thus, the term "monoacylglycerol acyltransferase activity" at least refers to the transfer of an acyl group from acyl-CoA to MAG to produce DAG. MGAT is best known for its role in fat absorption in the intestine of mammals, where the fatty acids and sn-2 MAG generated from the digestion of dietary fat are resynthesized into TAG in enterocytes for chylomicron synthesis and secretion. MGAT catalyzes the first step of this process, in which the acyl group from fatty acyl-CoA, formed from fatty acids and CoA, and sn-2 MAG are covalently joined. The term "MGAT" as used herein includes enzymes that act on sn-113 MAG and/or sn-2 MAG substrates to form sn-1,3 DAG and/or sn-1,2/2,3-DAG, respectively. In a preferred embodiment, the MGAT has a preference for sn-2 MAG substrate relative to sn-1 MAG, or substantially uses only sn-2 MAG as substrate (examples include MGATs described in Cao et al., 2003 (specificity of mouse MGAT1 for sn2-18:1-MAG>sn1/3-18:1-MAG (FIG. 5)); Yen and Farese, 2003 (general activities of mouse MGAT1 and human MGAT2 are higher on 2-MAG than on 1-MAG acyl-acceptor substrates (FIG. 5); and Cheng et al., 2003 (activity of human MGAT3 on 2-MAGs is much higher than on 1/3-MAG substrates (FIG. 2D)).

As used herein, MGAT does not include enzymes which transfer an acyl group preferentially to LysoPA relative to MAG, such enzymes are known as LPAATs. That is, a MGAT preferentially uses non-phosphorylated monoacyl substrates, even though they may have low catalytic activity on LysoPA. A preferred MGAT does not have detectable activity in acylating LysoPA. As shown herein, a MGAT (i.e., *M. musculus* MGAT2) may also have DGAT function but predominantly functions as a MGAT, i.e., it has greater catalytic activity as a MGAT than as a DGAT when the enzyme activity is expressed in units of nmoles product/min/mg protein (also see Yen et al., 2002).

There are three known classes of MGAT, referred to as, MGAT1, MGAT2 and MGAT3, respectively. Homologs of the human MGAT1 gene (AF384163; SEQ ID NO:7) are present (i.e. sequences are known) at least in chimpanzee, dog, cow, mouse, rat, zebrafish, *Caenorhabditis elegans*, *Schizosaccharomyces pombe*, *Saccharomyces cerevisiae*, *Kluyveromyces lactis*, *Eremothecium gossypii*, *Magnaporthe grisea*, and *Neurospora crassa*. Homologs of the human MGAT2 gene (AY157608) are present at least in chimpanzee, dog, cow, mouse, rat, chicken, zebrafish, fruit fly, and mosquito. Homologs of the human MGAT3 gene (AY229854) are present at least in chimpanzee, dog, cow, and zebrafish. However, homologs from other organisms can be readily identified by methods known in the art for identifying homologous sequences.

Examples of MGAT1 polypeptides include proteins encoded by MGAT1 genes from *Homo sapiens* (AF384163; SEQ ID NO:7), *Mus musculus* (AF384162; SEQ ID NO:8), *Pan troglodytes* (XM_001166055 and XM_0526044.2; SEQ ID NO:9 and SEQ ID NO:10, respectively), *Canis familiaris* (XM_545667.2; SEQ ID NO:11), *Bos taurus* (NM_001001153.2; SEQ ID NO:12), *Rattus norvegicus* (NM_001108803.1; SEQ ID NO:13), *Danio rerio* MGAT1 (NM_001122623.1; SEQ ID NO:14), *Caenorhabditis elegans* (NM_073012.4, NM_182380.5, NM_065258.3, NM_075068.3, and NM_072248.3; SEQ ID NO:15, SEQ ID NO:16, SEQ ID NO:17, SEQ ID NO:18, and SEQ ID NO:19, respectively), *Kluyveromyces lactis* (XM_455588.1; SEQ ID NO:20), *Ashbya gossypii* (NM_208895.1; SEQ ID NO:21), *Magnaporthe oryzae* (XM_368741.1; SEQ ID NO:22), *Ciona intestinalis* predicted (XM_002120843.1 SEQ ID NO:23). Examples of MGAT2 polypeptides include proteins encoded by MGAT2 genes from *Homo sapiens* (AY157608; SEQ ID NO:24), *Mus musculus* (AY157609; SEQ ID NO:25), *Pan troglodytes* (XM_522112.2; SEQ ID NO:26), *Canis familiaris* (XM_542304.1; SEQ ID NO:27), *Bos taurus* (NM_001099136.1; SEQ ID NO:28), *Rattus norvegicus* (NM_001109436.2; SEQ ID NO:29), *Gallus gallus* (XM_424082.2; SEQ ID NO:30), *Danio rerio* (NM_001006083.1 SEQ ID NO:31), *Drosophila melanogaster* (NM_136474.2, NM_136473.2, and NM_136475.2; SEQ ID NO:32, SEQ ID NO:33, and SEQ ID NO:34, respectively), *Anopheles gambiae* (XM_001688709.1 and XM_315985; SEQ ID NO:35 and SEQ ID NO:36, respectively), *Tribolium casta-* neum (XM_970053.1; SEQ ID NO:37). Examples of MGAT3 polypeptides include proteins encoded by MGAT3 genes from *Homo sapiens* (AY229854; SEQ ID NO:38), *Pan troglodytes* (XM_001154107.1, XM_001154171.1, and XM_527842.2; SEQ ID NO:39, SEQ ID NO:40, and SEQ ID NO:41), *Canis familiaris* (XM_845212.1; SEQ ID NO:42), *Bos taurus* (XM_870406.4; SEQ ID NO:43), *Danio rerio* (XM_688413.4; SEQ ID NO:44).

As used herein "MGAT pathway" refers to an anabolic pathway, different to the Kennedy pathway for the formation of TAG, in which DAG is formed by the acylation of either sn-1 MAG or preferably sn-2 MAG, catalysed by MGAT. The DAG may subsequently be used to form TAG or other lipids. The MGAT pathway is exemplified in FIG. 1.

As used herein, the term "diacylglycerol acyltransferase" (DGAT) refers to a protein which transfers a fatty acyl group from acyl-CoA to a DAG substrate to produce TAG. Thus, the term "diacylglycerol acyltransferase activity" refers to the transfer of an acyl group from acyl-CoA to DAG to produce TAG. A DGAT may also have MGAT function but predominantly functions as a DGAT, i.e., it has greater catalytic activity as a DGAT than as a MGAT when the enzyme activity is expressed in units of nmoles product/min/mg protein (see for example, Yen et al., 2005).

There are three known types of DGAT, referred to as DGAT1, DGAT2 and DGAT3, respectively. DGAT1 polypeptides typically have 10 transmembrane domains, DGAT2 polypeptides typically have 2 transmembrane domains, whilst DGAT3 polypeptides typically have none and are thought to be soluble in the cytoplasm, not integrated into membranes. Examples of DGAT1 polypeptides include proteins encoded by DGAT1 genes from *Aspergillus fumigatus* (XP_755172.1; SEQ ID NO:347), *Arabidopsis thaliana* (CAB44774.1; SEQ ID NO:83), *Ricinus communis* (AAR11479.1; SEQ ID NO:348), *Vernicia fordii* (ABC94472.1; SEQ ID NO:349), *Vernonia galamensis* (ABV21945.1 and ABV21946.1; SEQ ID NO:350 and SEQ ID NO:351, respectively), *Euonymus alatus* (AAV31083.1; SEQ ID NO:352), *Caenorhabditis elegans* (AAF82410.1; SEQ ID NO:353), *Rattus norvegicus* (NP_445889.1; SEQ ID NO:354), *Homo sapiens* (NP_036211.2; SEQ ID NO:355), as well as variants and/or mutants thereof. Examples of DGAT2 polypeptides include proteins encoded by DGAT2 genes from *Arabidopsis thaliana* (NP_566952.1; SEQ ID NO:212), *Ricinus communis* (AAY16324.1; SEQ ID NO:213), *Vernicia fordii* (ABC94474.1; SEQ ID NO:214), *Mortierella ramanniana* (AAK84179.1; SEQ ID NO:215), *Homo sapiens* (Q96PD7.2; SEQ ID NO:216) (Q58HT5.1; SEQ ID NO:217), *Bos taurus* (Q70VZ8.1; SEQ ID NO:218), *Mus musculus* (AAK84175.1; SEQ ID NO:219), as well as variants and/or mutants thereof.

Examples of DGAT3 polypeptides include proteins encoded by DGAT3 genes from peanut (*Arachis hypogaea*, Saha, et al., 2006), as well as variants and/or mutants thereof. A DGAT has little or no detectable MGAT activity, for example, less than 300 pmol/min/mg protein, preferably less than 200 pmol/min/mg protein, more preferably less than 100 pmol/min/mg protein.

DGAT2 but not DGAT1 shares high sequence homology with the MGAT enzymes, suggesting that DGAT2 and MGAT genes likely share a common genetic origin. Although multiple isoforms are involved in catalysing the same step in TAG synthesis, they may play distinct functional roles, as suggested by differential tissue distribution and subcellular localization of the DGAT/MGAT family of enzymes. In mammals, MGAT1 is mainly expressed in stomach, kidney, adipose tissue, whilst MGAT2 and MGAT3 show highest expression in the small intestine. In mammals, DGAT1 is ubiquitously expressed in many tissues, with highest expression in small intestine, whilst DGAT2 is most abundant in liver. MGAT3 only exists in higher mammals and humans, but not in rodents from bioinformatic analysis. MGAT3 shares higher sequence homology to DGAT2 than MGAT1 and MGAT3. MGAT3 exhibits significantly higher DGAT activity than MGAT1 and MGAT2 enzymes (MGAT3>MGAT1>MGAT2) when either MAGs or DAGs were used as substrates, suggesting MGAT3 functions as a putative TAG synthase.

Both MGAT1 and MGAT2 belong to the same class of acyltransferases as DGAT2. Some of the motifs that have been shown to be important for DGAT2 catalytic activity in some DGAT2s are also conserved in MGAT acyltransferases. Of particular interest is a putative neutral lipid-binding domain with the concensus sequence FLXLXXXN (SEQ ID NO:224) where each X is independently any amino acid other than proline, and N is any nonpolar amino acid, located within the N-terminal transmembrane region followed by a putative glycerol/phospholipid acyltransferase domain. The FLXLXXXN motif (SEQ ID NO:224) is found in the mouse DGAT2 (amino acids 81-88) and MGAT1/2 but not in yeast or plant DGAT2s. It is important for activity of the mouse DGAT2. Other DGAT2 and/or MGAT1/2 sequence motifs include:

1. A highly conserved YFP tripeptide (SEQ ID NO:220) in most DGAT2 polypeptides and also in MGAT1 and MGAT2, for example, present as amino acids 139-141 in mouse DGAT2. Mutating this motif within the yeast DGAT2 with non-conservative substitutions rendered the enzyme non-functional.

2. HPHG tetrapeptide (SEQ ID NO:221), highly conserved in MGATs as well as in DGAT2 sequences from animals and fungi, for example, present as amino acids 161-164 in mouse DGAT2, and important for catalytic activity at least in yeast and mouse DGAT2. Plant DGAT2 acyltransferases have a EPHS (SEQ ID NO:222) conserved sequence instead, so conservative changes to the first and fourth amino acids can be tolerated.

3. A longer conserved motif which is part of the putative glycerol phospholipid domain. An example of this motif is RXGFX(K/R)XAXXXGXXX(L/V)VPXXXFG(E/Q) (SEQ ID NO:223), which is present as amino acids 304-327 in mouse DGAT2. This motif is less conserved in amino acid sequence than the others, as would be expected from its length, but homologs can be recognised by motif searching. The spacing may vary between the more conserved amino acids, i.e., there may be additional X amino acids within the motif, or less X amino acids compared to the sequence above.

As used herein, the term "glycerol-3-phosphate acyltransferase" or "GPAT" refers to a protein which acylates glycerol-3-phosphate (G-3-P) to form LysoPA and/or MAG, the latter product forming if the GPAT also has phosphatase activity on LysoPA. The acyl group that is transferred is typically from acyl-CoA. Thus, the term "glycerol-3-phosphate acyltransferase activity" refers to the acylation of G-3-P to form LysoPA and/or MAG. The term "GPAT" encompasses enzymes that acylate G-3-P to form sn-1 LPA and/or sn-2 LPA, preferably sn-2 LPA. In a preferred embodiment, the GPAT has phosphatase activity. In a most preferred embodiment, the GPAT is a sn-2 GPAT having phosphatase activity which produces sn-2 MAG.

As used herein, the term "sn-1 glycerol-3-phosphate acyltransferase" (sn-1 GPAT) refers to a protein which acylates sn-glycerol-3-phosphate (G-3-P) to preferentially form 1-acyl-sn-glycerol-3-phosphate (sn-1 LPA). Thus, the term "sn-1 glycerol-3-phosphate acyltransferase activity" refers to the acylation of sn-glycerol-3-phosphate to form 1-acyl-sn-glycerol-3-phosphate (sn-1 LPA).

As used herein, the term "sn-2 glycerol-3-phosphate acyltransferase" (sn-2 GPAT) refers to a protein which acylates sn-glycerol-3-phosphate (G-3-P) to preferentially form 2-acyl-sn-glycerol-3-phosphate (sn-2 LPA). Thus, the term "sn-2 glycerol-3-phosphate acyltransferase activity" refers to the acylation of sn-glycerol-3-phosphate to form 2-acyl-sn-glycerol-3-phosphate (sn-2 LPA).

The GPAT family is large and all known members contain two conserved domains, a plsC acyltransferase domain (PF01553; SEQ ID NO:225) and a HAD-like hydrolase (PF12710; SEQ ID NO:226) superfamily domain. In addition to this, in *Arabidopsis thaliana*, GPAT4-8 all contain a N-terminal region homologous to a phosphoserine phosphatase domain (PF00702; SEQ ID NO:227). GPAT4 and GPAT6 both contain conserved residues that are known to be critical to phosphatase activity, specifically conserved amino acids (shown in bold) in Motif I (DXDX[T/V][LN]; SEQ ID NO:229) and Motif III (K-[G/S][D/S]XXX[D/N]; SEQ ID NO:330) located at the N-terminus (Yang et al., 2010). Preferably, the GPAT has sn-2 preference and phosphatase activity to produce sn-2 MAG (also referred to herein as "2-MAG") from glycerol-3-phosphate (G-3-P) (FIG. 1), for example, GPAT4 (NP_171667.1; SEQ ID NO:144) and GPAT6 (NP_181346.1; SEQ ID NO:145) from *Arabidopsis*. More preferably, the GPAT uses acyl-CoA as a fatty acid substrate.

Homologues of GPAT4 (NP_171667.1; SEQ ID NO:144) and GPAT6 (NP_181346.1; SEQ ID NO:145) include AAF02784.1 (*Arabidopsis thaliana*; SEQ ID NO:146), AAL32544.1 (*Arabidopsis thaliana*; SEQ ID NO:147), AAP03413.1 (*Oryza sativa*; SEQ ID NO:148), ABK25381.1 (*Picea sitchensis*; SEQ ID NO:149), ACN34546.1 (*Zea Mays*; SEQ ID NO:150), BAF00762.1 (*Arabidopsis thaliana*; SEQ ID NO:151), BAH00933.1 (*Oryza sativa*; SEQ ID NO:152), EAY84189.1 (*Oryza sativa*; SEQ ID NO:153), EAY98245.1 (*Oryza sativa*; SEQ ID NO:154), EAZ21484.1 (*Oryza sativa*; SEQ ID NO:155), EEC71826.1 (*Oryza sativa*; SEQ ID NO:156), EEC76137.1 (*Oryza sativa*; SEQ ID NO:157), EEE59882.1 (*Oryza sativa*; SEQ ID NO:158), EFJ08963.1 (*Selaginella moellendorffii*; SEQ ID NO:159), EFJ08964.1 (*Selaginella moellendorffii*; SEQ ID NO:160), EFJ11200.1 (*Selaginella moellendorffii*; SEQ ID NO:161), EFJ15664.1 (*Selaginella moellendorffii*; SEQ ID NO:162), EFJ24086.1 (*Selaginella moellendorffii*; SEQ ID NO:163), EFJ29816.1 (*Selaginella moellendorffii*; SEQ ID NO:164), EFJ29817.1 (*Selaginella moellendorffii*; SEQ ID NO:165), NP_001044839.1 (*Oryza sativa*; SEQ ID NO:166), NP_001045668.1 (*Oryza sativa*; SEQ ID NO:167), NP_001147442.1 (*Zea mays*; SEQ ID NO:168), NP_001149307.1 (*Zea mays*; SEQ ID NO:169), NP_001168351.1 (*Zea mays*; SEQ ID NO:170), AFH02724.1 (*Brassica napus*; SEQ ID NO:171) NP_191950.2 (*Arabidopsis thaliana*; SEQ ID NO:172), XP_001765001.1 (*Physcomitrella patens*; SEQ ID NO:173), XP_001769671.1 (*Physcomitrella patens;* SEQ ID NO:174), XP_001769724.1 (*Physcomitrella patens*; SEQ ID NO:175), XP_001771186.1 (*Physcomitrella patens*; SEQ ID NO:176), XP_001780533.1 (*Physcomitrella patens*; SEQ ID NO:177), XP_002268513.1 (*Vitis vinifera*; SEQ ID NO:178), XP_002275348.1 (*Vitis vinifera*; SEQ ID NO:179), XP_002276032.1 (*Vitis vinifera*; SEQ ID NO:180), XP_002279091.1 (*Vitis vinifera*; SEQ ID NO:181), XP_002309124.1 (*Populus trichocarpa*; SEQ ID NO:182), XP_002309276.1 (*Populus trichocarpa*; SEQ ID NO:183), XP_002322752.1 (*Populus trichocarpa*; SEQ ID NO:184), XP_002323563.1 (*Populus trichocarpa*; SEQ ID NO:185), XP_002439887.1 (*Sorghum bicolor*; SEQ ID NO:186), XP_002458786.1 (*Sorghum bicolor*; SEQ ID NO:187), XP_002463916.1 (*Sorghum bicolor*; SEQ ID NO:188), XP_002464630.1 (*Sorghum bicolor*; SEQ ID NO:189), XP_002511873.1 (*Ricinus communis*; SEQ ID NO:190), XP_002517438.1 (*Ricinus communis*; SEQ ID NO:191), XP_002520171.1 (*Ricinus communis*; SEQ ID NO:192), XP_002872955.1 (*Arabidopsis lyrata*; SEQ ID NO:193), XP_002881564.1 (*Arabidopsis lyrata*; SEQ ID NO:194), ACT32032.1 (*Vernicia fordii*; SEQ ID NO:195), NP_001051189.1 (*Oryza sativa*; SEQ ID NO:196), AFH02725.1 (*Brassica napus*; SEQ ID NO:197), XP_002320138.1 (*Populus trichocarpa*; SEQ ID NO:198), XP_002451377.1 (*Sorghum bicolor*; SEQ ID NO:199), XP_002531350.1 (*Ricinus communis*; SEQ ID NO:200), and XP_002889361.1 (*Arabidopsis lyrata*; SEQ ID NO:201).

Conserved motifs and/or residues can be used as a sequence-based diagnostic for the identification of bifunctional GPAT/phosphatase enzymes. Alternatively, a more stringent function-based assay could be utilised. Such an assay involves, for example, feeding labelled glycerol-3-phosphate to cells or microsomes and quantifying the levels of labelled products by thin-layer chromatography or a similar technique. GPAT activity results in the production of labelled LPA whilst GPAT/phosphatase activity results in the production of labelled MAG.

As used herein, the term "Oleosin" refers to an amphipathic protein present in the membrane of oil bodies in the storage tissues of seeds (see, for example, Huang, 1996; Lin et al., 2005; Capuano et al., 2007; Lui et al., 2009; Shimada and Hara-Nishimura, 2010).

Plant seeds accumulate TAG in subcellular structures called oil bodies. These organelles consist of a TAG core surround by a phospholipid monolayer containing several embedded proteins including oleosins (Jolivet et al., 2004). Oleosins represent the most abundant protein in the membrane of oil bodies.

Oleosins are of low $M_r$ (15-26,000). Within each seed species, there are usually two or more oleosins of different $M_r$. Each oleosin molecule contains a relatively hydrophilic N-terminal domain (for example, about 48 amino acid residues), a central totally hydrophobic domain (for example, of about 70-80 amino acid residues) which is particularly rich in aliphatic amino acids such as alanine, glycine, leucine, isoleucine and valine, and an amphipathic α-helical domain (for example, about of about 33 amino acid residues) at or near the C-terminus. Generally, the central stretch of hydrophobic residues is inserted into the lipid core and the amphiphatic N-terminal and/or amphiphatic C-terminal are located at the surface of the oil bodies, with positively charged residues embedded in a phospholipid monolayer and the negatively charged ones exposed to the exterior.

As used herein, the term "Oleosin" encompasses polyoleosins which have multiple oleosin polypeptides fused together as a single polypeptide, for example 2×, 4× or 6× oleosin peptides, and caleosins which bind calcium (Froissard et al., 2009), and steroleosins which bind sterols. However, generally a large proportion of the oleosins of oil bodies will not be caleosins and/or steroleosins.

A substantial number of oleosin protein sequences, and nucleotide sequences encoding therefor, are known from a large number of different plant species. Examples include, but are not limited to, oleosins from *Arabidposis*, canola, corn, rice, peanut, castor, soybean, flax, grape, cabbage, cotton, sunflower, sorghum and barley. Examples of oleosins (with their Accession Nos) include *Brassica napus* oleosin (CAA57545.1; SEQ ID NO:362), *Brassica napus* oleosin S1-1 (ACG69504.1; SEQ ID NO:363), *Brassica napus* oleosin S2-1 (ACG69503.1; SEQ ID NO:364), *Brassica napus* oleosin S3-1 (ACG69513.1; SEQ ID NO:365), *Brassica napus* oleosin S4-1 (ACG69507.1; SEQ ID NO:366), *Brassica napus* oleosin S5-1 (ACG69511.1; SEQ ID NO:367), *Arachis hypogaea* oleosin 1 (AAZ20276.1; SEQ ID NO:368), *Arachis hypogaea* oleosin 2 (AAU21500.1; SEQ ID NO:369), *Arachis hypogaea* oleosin 3 (AAU21501.1; SEQ ID NO:370), *Arachis hypogaea* oleosin 5 (ABC96763.1; SEQ ID NO:371), *Ricinus communis* oleosin 1 (EEF40948.1; SEQ ID NO:372), *Ricinus communis* oleosin 2 (EEF51616.1; SEQ ID NO:373), *Glycine max* oleosin isoform a (P29530.2; SEQ ID NO:374), *Glycine max* oleosin isoform b (P29531.1; SEQ ID NO:375), *Linum usitatissimum* oleosin low molecular weight isoform (ABB01622.1; SEQ ID NO:376), *Linum usitatissimum* oleosin high molecular weight isoform (ABB01624.1; SEQ ID NO:377), *Helianthus annuus* oleosin (CAA44224.1; SEQ ID NO:378), *Zea mays* oleosin (NP_001105338.1; SEQ ID NO:379), *Brassica napus* steroleosin (ABM30178.1; SEQ ID NO:380), *Brassica napus* steroleosin SLO1-1 (ACG69522.1; SEQ ID NO:381), *Brassica napus* steroleosin SLO2-1 (ACG69525.1; SEQ ID NO:382), *Sesamum indicum* steroleosin (AAL13315.1; SEQ ID NO:383), *Zea mays* steroleosin (NP_001152614.1; SEQ ID NO:384), *Brassica napus* caleosin CLO-1 (ACG69529.1; SEQ ID NO:385), *Brassica napus* caleosin CLO-3 (ACG69527.1; SEQ ID NO:386), *Sesamum indicum* caleosin (AAF13743.1; SEQ ID NO:387), *Zea mays* caleosin (NP_001151906.1; SEQ ID NO:388).

As used herein, the term a "polypeptide involved in starch biosynthesis" refers to any polypeptide, the downregulation of which in a cell below normal (wild-type) levels results in a reduction in the level of starch synthesis and an increase in the levels of starch. An example of such a polypeptide is AGPase.

As used herein, the term "ADP-glucose phosphorylase" or "AGPase" refers to an enzyme which regulates starch biosynthesis, catalysing conversion of glucose-1-phosphate and ATP to ADP-glucose which serves as the building block for starch polymers. The active form of the AGPase enzyme consists of 2 large and 2 small subunits.

The ADPase enzyme in plants exists primarily as a tetramer which consists of 2 large and 2 small subunits. Although these subunits differ in their catalytic and regulatory roles depending on the species (Kuhn et al., 2009), in plants the small subunit generally displays catalytic activity. The molecular weight of the small subunit is approximately 50-55 kDa. The molecular weight of the large subunit is approximately 55-60 kDa. The plant enzyme is strongly activated by 3-phosphoglycerate (PGA), a product of carbon dioxide fixation; in the absence of PGA, the enzyme exhibits only about 3% of its activity. Plant AGPase is also strongly inhibited by inorganic phosphate (Pi). In contrast, bacterial and algal AGPase exist as homotetramers of 50 kDa. The algal enzyme, like its plant counterpart, is activated by PGA and inhibited by Pi, whereas the bacterial enzyme is activated by fructose-1,6-bisphosphate (FBP) and inhibited by AMP and Pi.

As used herein, the term "polypeptide involved in the degradation of lipid and/or which reduces lipid content" refers to any polypeptide, the downregulation of which in a cell below normal (wild-type) levels results an increase in the level of oil, such as fatty acids and/or TAGs, in the cell, preferably a cell of vegetative tissue of a plant. Examples of such polypeptides include, but are not limited, lipases, or a lipase such as CGi58 polypeptide, SUGAR-DEPENDENT1 triacylglycerol lipase (see, for example, Kelly et al., 2012) or a lipase described in WO 2009/027335.

As used herein, the term "lipase" refers to a protein which hydrolyzes fats into glycerol and fatty acids. Thus, the term "lipase activity" refers to the hydrolysis of fats into glycerol and fatty acids.

As used herein, the term "CGi58" refers to a soluble acyl-CoA-dependent lysophosphatidic acid acyltransferase also known in the art as "At4g24160" (in plants) and "Ict1p" (in yeast). The plant gene such as that from *Arabidopsis* gene locus, At4g24160, is expressed as two alternative transcripts: a longer full-length isoform (At4g24160.1) and a smaller isoform (At4g24160.2) missing a portion of the 3' end (see James et al., 2010; Ghosh et al., 2009; US 201000221400). Both mRNAs code for a protein that is homologous to the human CGI-58 protein and other orthologous members of this a/13 hydrolase family (ABHD). In an embodiment, the CGI58 (At4g24160) protein contains three motifs that are conserved across plant species: a GXSXG lipase motif (SEQ ID NO:419), a HX(4)D acyltransferase motif (SEQ ID NO:420), and VX(3)HGF, a probable lipid binding motif (SEQ ID NO:421). The human CGI-58 protein has lysophosphatidic acid acyltransferase (LPAAT) activity but not lipase activity. In contrast, the plant and yeast proteins possess a canonical lipase sequence motif GXSXG (SEQ ID NO:419), that is absent from vertebrate (humans, mice, and zebrafish) proteins. Although the plant and yeast CGI58 proteins appear to possess detectable amounts of TAG lipase and phospholipase A activities in addition to LPAAT activity, the human protein does not.

Disruption of the homologous CGI-58 gene in *Arabidopsis thaliana* results in the accumulation of neutral lipid droplets in mature leaves. Mass spectroscopy of isolated lipid droplets from cgi-58 loss-of-function mutants showed they contain triacylglycerols with common leaf-specific fatty acids. Leaves of mature cgi-58 plants exhibit a marked increase in absolute triacylglycerol levels, more than 10-fold higher than in wild-type plants. Lipid levels in the oil-storing seeds of cgi-58 loss-of-function plants were unchanged, and unlike mutations in β-oxidation, the cgi-58 seeds germinated and grew normally, requiring no rescue with sucrose (James et al., 2010).

Examples of CGi58 polypeptides include proteins from *Arabidopsis thaliana* (NP_194147.2; SEQ ID NO:429), *Brachypodium distachyon* (XP_003578450.1; SEQ ID NO:430), *Glycine max* (XP_003523638.1; SEQ ID NO:431), *Zea mays* (NP_001149013.1; SEQ ID NO:432), *Sorghum bicolor* (XP_002460538.1; SEQ ID NO:433), *Ricinus communis* (XP_002510485.1; SEQ ID NO:434), *Medicago truncatula* (XP_003603733.1; SEQ ID NO:435), and *Oryza sativa* (EAZ09782.1; SEQ ID NO:436).

As used herein, the term "Leafy Cotyledon 2" or "LEC2" refers to a B3 domain transcription factor which participates in zygotic and in somatic embryogenesis. Its ectopic expression facilitates the embryogenesis from vegetative plant tissues (Alemanno et al., 2008). LEC2 also comprises a DNA binding region found thus far only in plant proteins. Examples of LEC2 polypeptides include proteins from *Arabidopsis thaliana* (NP_564304.1) (SEQ ID NO:442), *Medicago truncatula* (CAA42938.1) (SEQ ID NO:443) and *Brassica napus* (ADO16343.1) (SEQ ID NO:444).

As used herein, the term "BABY BOOM" or "BBM" refers an AP2/ERF transcription factor that induces regeneration under culture conditions that normally do not support regeneration in wild-type plants. Ectopic expression of *Brassica napus* BBM (BnBBM) genes in *B. napus* and *Arabidopsis* induces spontaneous somatic embryogenesis and organogenesis from seedlings grown on hormone-free basal medium (Boutilier et al., 2002). In tobacco, ectopic BBM expression is sufficient to induce adventitious shoot and root regeneration on basal medium, but exogenous cytokinin is required for somatic embryo (SE) formation (Srinivasan et al., 2007). Examples of BBM polypeptides include proteins from *Arabidopsis thaliana* (NP_197245.2) (SEQ ID NO:445) and *Medicago truncatula* (AAW82334.1) (SEQ ID NO:446).

As used herein, the term "FAD2" refers to a membrane bound delta-12 fatty acid desturase that desaturates oleic acid (18:1$^{\Delta 9}$) to produce linoleic acid (C18:2$^{\Delta 9,12}$).

As used herein, the term "epoxygenase" or "fatty acid epoxygenase" refers to an enzyme that introduces an epoxy group into a fatty acid resulting in the production of an epoxy fatty acid. In preferred embodiment, the epoxy group is introduced at the 12th carbon on a fatty acid chain, in which case the epoxygenase is a Δ12-epoxygenase, especially of a C16 or C18 fatty acid chain. The epoxygenase may be a Δ9-epoxygenase, a Δ15 epoxygenase, or act at a different position in the acyl chain as known in the art. The epoxygenase may be of the P450 class. Preferred epoxygenases are of the mono-oxygenase class as described in WO98/46762. Numerous epoxygenases or presumed epoxygenases have been cloned and are known in the art. Further examples of expoxygenases include proteins comprising an amino acid sequence provided in SEQ ID NO:21 of WO 2009/129582, polypeptides encoded by genes from *Crepis paleastina* (CAA76156, Lee et al., 1998), *Stokesia laevis* (AAR23815, Hatanaka et al., 2004) (monooxygenase type), *Euphorbia lagascae* (AAL62063) (P450 type), human CYP2J2 (arachidonic acid epoxygenase, U37143); human CYPIA1 (arachidonic acid epoxygenase, K03191), as well as variants and/or mutants thereof.

As used herein, the term, "hydroxylase" or "fatty acid hydroxylase" refers to an enzyme that introduces a hydroxyl group into a fatty acid resulting in the production of a hydroxylated fatty acid. In a preferred embodiment, the hydroxyl group is introduced at the 2nd, 12th and/or 17th carbon on a C18 fatty acid chain. Preferably, the hydroxyl group is introduced at the 12$^{th}$ carbon, in which case the hydroxylase is a Δ12-hydroxylase. In another preferred embodiment, the hydroxyl group is introduced at the 15th carbon on a C16 fatty acid chain. Hydroxylases may also have enzyme activity as a fatty acid desaturase. Examples of genes encoding Δ12-hydroxylases include those from *Ricinus communis* (AAC9010, van de Loo 1995); *Physaria lindheimeri*, (ABQ01458, Dauk et al., 2007); *Lesquerella fendleri*, (AAC32755, Broun et al., 1998); *Daucus carota*, (AAK30206); fatty acid hydroxylases which hydroxylate the terminus of fatty acids, for example: *A. thaliana* CYP86A1 (P48422, fatty acid ω-hydroxylase); *Vicia sativa* CYP94A1 (P98188, fatty acid ω-hydroxylase); mouse CYP2E1 (X62595, lauric acid co-1 hydroxylase); rat CYP4A1 (M57718, fatty acid ω-hydroxylase), as well as variants and/or mutants thereof.

As used herein, the term "conjugase" or "fatty acid conjugase" refers to an enzyme capable of forming a conjugated bond in the acyl chain of a fatty acid. Examples of conjugases include those encoded by genes from *Calendula officinalis* (AF343064, Qiu et al., 2001); *Vernicia fordii* (AAN87574, Dyer et al., 2002); *Punica granatum* (AY178446, Iwabuchi et al., 2003) and *Trichosanthes kirilowii* (AY178444, Iwabuchi et al., 2003); as well as variants and/or mutants thereof.

As used herein, the term "acetylenase" or "fatty acid acetylenase" refers to an enzyme that introduces a triple bond into a fatty acid resulting in the production of an acetylenic fatty acid. In a preferred embodiment, the triple bond is introduced at the 2nd, 6th, 12th and/or 17th carbon on a C18 fatty acid chain. Examples acetylenases include those from *Helianthus annuus* (AA038032, ABC59684), as well as variants and/or mutants thereof.

Examples of such fatty acid modifying genes include proteins according to the following Accession Numbers which are grouped by putative function, and homologues from other species: Δ12 acetylenases ABC00769, CAA76158, AAO38036, AAO38032; Δ12 conjugases AAG42259, AAG42260, AAN87574; Δ12 desaturases P46313, ABS18716, AAS57577, AAL61825, AAF04093, AAF04094; Δ12 epoxygenases XP_001840127, CAA76156, AAR23815; Δ12 hydroxylases ACF37070, AAC32755, ABQ01458, AAC49010; and Δ12 P450 enzymes such as AF406732.

As used herein, the term "vegetative tissue" or "vegetative plant part" is any plant tissue, organ or part other than organs for sexual reproduction of plants, specifically seed bearing organs, flowers, pollen, fruits and seeds. Vegetative tissues and parts include at least plant leaves, stems (including bolts and tillers but excluding the heads), tubers and roots, but excludes flowers, pollen, seed including the seed coat, embryo and endosperm, fruit including mesocarp tissue, seed-bearing pods and seed-bearing heads. In one embodiment, the vegetative part of the plant is an aerial plant part. In another or further embodiment, the vegetative plant part is a green part such as a leaf or stem.

As used herein, the term "wild-type" or variations thereof refers to a cell, or non-human organism or part thereof that has not been genetically modified.

The term "corresponding" refers to a vegetative plant part, a cell, or non-human organism or part thereof, or seed that has the same or similar genetic background as a vegetative plant part, a cell, or non-human organism or part thereof, or seed of the invention but that has not been modified as described herein (for example, a vegetative plant part, a cell, or non-human organism or part thereof, or seed lacks an exogenous polynucleotide encoding a MGAT or an exogenous MGAT). In a preferred embodiment, a vegetative plant part, a cell, or non-human organism or part thereof, or seed is at the same developmental stage as a vegetative plant part, a cell, or non-human organism or part thereof, or seed of the invention. For example, if the non-human organism is a flowering plant, then preferably the corresponding plant is also flowering. A corresponding vegetative plant part, a cell, or non-human organism or part thereof, or seed can be used as a control to compare levels of nucleic acid or protein expression, or the extent and nature of trait modification, for example non-polar lipid production and/or content, with a vegetative plant part, a cell, or non-human organism or part thereof, or seed modified as described herein. A person skilled in the art is readily able to determine an appropriate "corresponding" cell, tissue, organ or organism for such a comparison.

As used herein "compared with" refers to comparing levels of a non-polar lipid or total non-polar lipid content of the transgenic non-human organism or part thereof expressing the one or more exogenous polynucleotides or exogenous polypeptides with a transgenic non-human organism or part thereof lacking the one or more exogenous polynucleotides or polypeptides.

As used herein, "enhanced ability to produce non-polar lipid" is a relative term which refers to the total amount of non-polar lipid being produced by a cell, or non-human organism or part thereof of the invention being increased relative to a corresponding cell, or non-human organism or part thereof. In one embodiment, the TAG and/or polyunsaturated fatty acid content of the non-polar lipid is increased.

As used herein, "germinate at a rate substantially the same as for a corresponding wild-type plant" refers to seed of a plant of the invention being relatively fertile when compared to seed of a wild type plant lacking the defined exogenous polynucleotide(s). In one embodiment, the number of seeds which germinate, for instance when grown under optimal greenhouse conditions for the plant species, is at least 75%, more preferably at least 90%, of that when compared to corresponding wild-type seed. In another embodiment, the seeds which germinate, for instance when grown under optimal greenhouse conditions for the plant species, grow at a rate which, on average, is at least 75%, more preferably at least 90%, of that when compared to corresponding wild-type plants.

As used herein, the term "an isolated or recombinant polynucleotide which down regulates the production and/or activity of an endogenous enzyme" or variations thereof, refers to a polynucleotide that encodes an RNA molecule that down regulates the production and/or activity (for example, encoding an siRNA, hpRNAi), or itself down regulates the production and/or activity (for example, is an siRNA which can be delivered directly to, for example, a cell) of an endogenous enzyme for example, DGAT, sn-1 glycerol-3-phosphate acyltransferase (GPAT), 1-acyl-glycerol-3-phosphate acyltransferase (LPAAT), acyl-CoA:lysophosphatidylcholine acyltransferase (LPCAT), phosphatidic acid phosphatase (PAP), AGPase, or delta-12 fatty acid desturase (FAD2), or a combination of two or more thereof.

As used herein, the term "on a weight basis" refers to the weight of a substance (for example, TAG, DAG, fatty acid) as a percentage of the weight of the composition comprising the substance (for example, seed, leaf). For example, if a transgenic seed has 25 µg total fatty acid per 120 µg seed weight; the percentage of total fatty acid on a weight basis is 20.8%.

As used herein, the term "on a relative basis" refers to the amount of a substance in a composition comprising the substance in comparison with a corresponding composition, as a percentage.

As used herein, the term "the relative non-lipid content" refers to the expression of the non-polar lipid content of a cell, organism or part thereof, or extracted lipid therefrom, in comparison with a corresponding cell, organism or part thereof, or the lipid extracted from the corresponding cell, organism or part thereof, as a percentage. For example, if a transgenic seed has 25 µg total fatty acid, whilst the corresponding seed had 20 µg total fatty acid; the increase in non-polar lipid content on a relative basis equals 25%.

As used herein, the term "biofuel" refers to any type of fuel, typically as used to power machinery such as automobiles, trucks or petroleum powered motors, whose energy is derived from biological carbon fixation. Biofuels include fuels derived from biomass conversion, as well as solid biomass, liquid fuels and biogases. Examples of biofuels include bioalcohols, biodiesel, synthetic diesel, vegetable oil, bioethers, biogas, syngas, solid biofuels, algae-derived fuel, biohydrogen, biomethanol, 2,5-Dimethylfuran (DMF), biodimethyl ether (bioDME), Fischer-Tropsch diesel, biohydrogen diesel, mixed alcohols and wood diesel.

As used herein, the term "bioalcohol" refers to biologically produced alcohols, for example, ethanol, propanol and butanol. Bioalcohols are produced by the action of microorganisms and/or enzymes through the fermentation of sugars, hemicellulose or cellulose.

As used herein, the term "biodiesel" refers to a composition comprising fatty acid methyl- or ethyl-esters derived from non-polar lipids by transesterification.

As used herein, the term "synthetic diesel" refers to a form of diesel fuel which is derived from renewable feedstock rather than the fossil feedstock used in most diesel fuels.

As used herein, the term "vegetable oil" includes a pure plant oil (or straight vegetable oil) or a waste vegetable oil (by product of other industries).

As used herein, the term 'bioethers" refers to compounds that act as octane rating enhancers.

As used herein, the term "biogas" refers to methane or a flammable mixture of methane and other gases produced by anaerobic digestion of organic material by anaerobes.

As used herein, the term "syngas" refers to a gas mixture that contains varying amounts of carbon monoxide and hydrogen and possibly other hydrocarbons, produced by partial combustion of biomass.

As used herein, the term "solid biofuels" includes wood, sawdust, grass trimmining, and non-food energy crops.

As used herein, the term "cellulosic ethanol" refers to ethanol produced from cellulose or hemicellulose.

As used herein, the term "algae fuel" refers to a biofuel made from algae and includes algal biodiesel, biobutanol, biogasoline, methane, ethanol, and the equivalent of vegetable oil made from algae.

As used herein, the term "biohydrogen" refers to hydrogen produced biologically by, for example, algae.

As used herein, the term "biomethanol" refers to methanol produced biologically. Biomethanol may be produced by gasification of organic materials to syngas followed by conventional methanol synthesis.

As used herein, the term "2,5-Dimethylfuran" or "DMF" refers to a heterocyclic compound with the formula $(CH_3)_2 C_4H_2O$. DMF is a derivative of furan that is derivable from cellulose.

As used herein, the term "biodimethyl ether" or "bioDME", also known as methoxymethane, refers to am organic compound with the formula $CH_3OCH_3$. Syngas may be converted into methanol in the presence of catalyst (usually copper-based), with subsequent methanol dehydration in the presence of a different catalyst (for example, silica-alumina) resulting in the production of DME.

As used herein, the term "Fischer-Tropsch" refers to a set of chemical reactions that convert a mixture of carbon monoxide and hydrogen into liquid hydrocarbons. The syngas can first be conditioned using for example, a water gas shift to achieve the required $H_2/CO$ ratio. The conversion takes place in the presence of a catalyst, usually iron or cobalt. The temperature, pressure and catalyst determine whether a light or heavy syncrude is produced. For example at 330° C. mostly gasoline and olefins are produced whereas at 180° to 250° C. mostly diesel and waxes are produced. The liquids produced from the syngas, which comprise various hydrocarbon fractions, are very clean (sulphur free) straight-chain hydrocarbons. Fischer-Tropsch diesel can be produced directly, but a higher yield is achieved if first Fischer-Tropsch wax is produced, followed by hydrocracking.

As used herein, the term "biochar" refers to charcoal made from biomass, for example, by pyrolysis of the biomass.

As used herein, the term "feedstock" refers to a material, for example, biomass or a conversion product thereof (for example, syngas) when used to produce a product, for example, a biofuel such as biodiesel or a synthetic diesel.

As used herein, the term "industrial product" refers to a hydrocarbon product which is predominantly made of carbon and hydrogen such as fatty acid methyl- and/or ethyl-esters or alkanes such as methane, mixtures of longer chain alkanes which are typically liquids at ambient temperatures, a biofuel, carbon monoxide and/or hydrogen, or a bioalcohol such as ethanol, propanol, or butanol, or biochar. The term "industrial product" is intended to include intermediary products that can be converted to other industrial products, for example, syngas is itself considered to be an industrial product which can be used to synthesize a hydrocarbon product which is also considered to be an industrial product. The term industrial product as used herein includes both pure forms of the above compounds, or more commonly a mixture of various compounds and components, for example the hydrocarbon product may contain a range of carbon chain lengths, as well understood in the art.

As used herein, "gloss" refers to an optical phenomenon caused when evaluating the appearance of a surface. The evaluation of gloss describes the capacity of a surface to reflect directed light.

Throughout this specification the word "comprise", or variations such as "comprises" or "comprising", will be understood to imply the inclusion of a stated element, integer or step, or group of elements, integers or steps, but not the exclusion of any other element, integer or step, or group of elements, integers or steps.

The term "and/or", e.g., "X and/or Y" shall be understood to mean either "X and Y" or "X or Y" and shall be taken to provide explicit support for both meanings or for either meaning.

As used herein, the term about, unless stated to the contrary, refers to +/−10%, more preferably +/−5%, more preferably +/−2%, more preferably +/−1%, even more preferably +/−0.5%, of the designated value.

Production of Diacylgylerols and Triacylglycerols

In one embodiment, the vegetative plant part, transgenic non-human organism or part thereof of the invention produces higher levels of non-polar lipids such as DAG or TAG, preferably both, than a corresponding vegetative plant part, non-human organism or part thereof. In one example, transgenic plants of the invention produce seeds, leaves, leaf portions of at least 1 cm$^2$ in surface area, stems and/or tubers having an increased non-polar lipid content such as DAG or TAG, preferably both, when compared to corresponding seeds, leaves, leaf portions of at least 1 cm$^2$ in surface area, stems or tubers. The non-polar lipid content of the vegetative plant part, non-human organism or part thereof is at 0.5% greater on a weight basis when compared to a corresponding non-human organism or part thereof, or as further defined in Feature (i).

In another embodiment, the vegetative plant part, transgenic non-human organism or part thereof, preferably a plant or seed, produce DAGs and/or TAGs that are enriched for one or more particular fatty acids. A wide spectrum of fatty acids can be incorporated into DAGs and/or TAGs, including saturated and unsaturated fatty acids and short-chain and long-chain fatty acids. Some non-limiting examples of fatty acids that can be incorporated into DAGs and/or TAGs and which may be increased in level include: capric (10:0), lauric (12:0), myristic (14:0), palmitic (16:0), palmitoleic (16:1), stearic (18:0), oleic (18:1), vaccenic (18:1), linoleic (18:2), eleostearic (18:3), γ-linolenic (18:3), α-linolenic (18:36)$_3$), stearidonic (18:40), arachidic (20:0), eicosadienoic (20:2), dihomo-γ-linoleic (20:3), eicosatrienoic (20:3), arachidonic (20:4), eicosatetraenoic (20:4), eicosapentaenoic (20:5ω3), behenic (22:0), docosapentaenoic (22:5ω), docosahexaenoic (22:6ω3), lignoceric (24:0), nervonic (24:1), cerotic (26:0), and montanic (28:0) fatty acids. In one embodiment of the present invention, the vegetative plant part, transgenic organism or parts thereof is enriched for DAGs and/or TAGs comprising oleic acid, or polyunsaturated fatty acids.

In one embodiment of the invention, the vegetative plant part, transgenic non-human organism or part thereof, preferably a plant or seed, is transformed with a chimeric DNA which encodes an MGAT which may or may not have DGAT activity. Expression of the MGAT preferably results in higher levels of non-polar lipids such as DAG or TAG and/or increased non-polar lipid yield in said vegetative plant part, transgenic non-human organism or part thereof. In a preferred embodiment, the transgenic non-human organism is a plant.

In a further embodiment, the vegetative plant part, transgenic non-human organism or part thereof is transformed with a chimeric DNA which encodes a GPAT or a DGAT. Preferably, the vegetative plant part or transgenic non-human organism is transformed with both chimeric DNAs, which are preferably covalently linked on one DNA molecule such as, for example, a single T-DNA molecule.

Yang et al. (2010) describe two glycerol-3-phosphate acyltransferases (GPAT4 and GPAT6) from *Arabidopsis* with sn-2 preference and phosphatase activity that are able to produce sn-2 MAG from glycerol-3-phosphate (G-3-P) (FIG. 1). These enzymes are proposed to be part of the cutin synthesis pathway. *Arabidopsis* GPAT4 and GPAT6 have been shown to use acyl-CoA as a fatty acid substrate (Zheng et al., 2003).

Combining a bifunctional GPAT/phosphatase with a MGAT yields a novel DAG synthesis pathway using G-3-P as one substrate and two acyl groups derived from acyl-CoA as the other substrates. Similarly, combining such a bifunctional GPAT/phosphatase with a MGAT which has DGAT activity yields a novel TAG synthesis pathway using glycerol-3-phosphate as one substrate and three acyl groups derived from acyl-CoA as other substrates.

Figure 2:
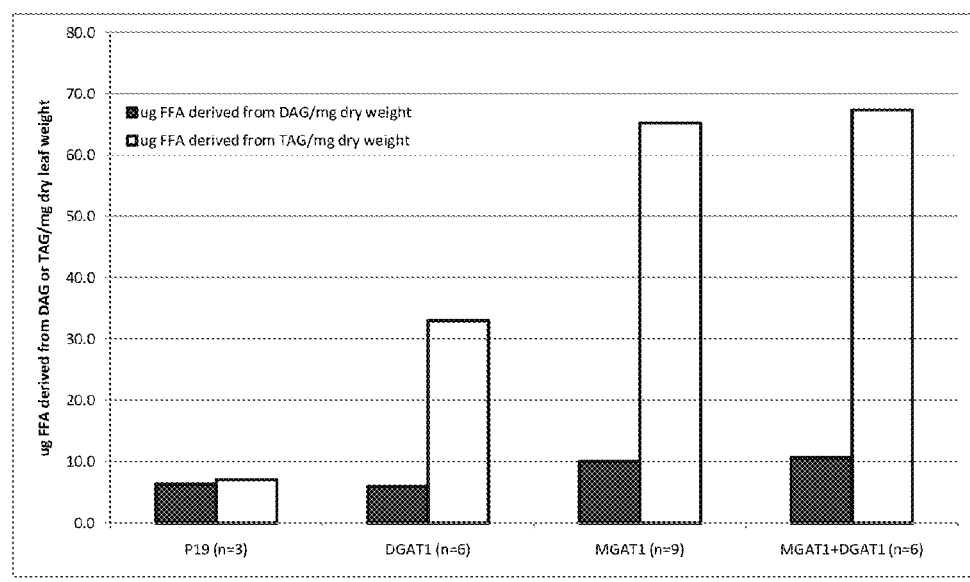

Accordingly, in one embodiment of the invention, the vegetative plant part, transgenic non-human organism or part thereof is co-transformed with a bifunctional GPAT/phosphatase and with a MGAT which does not have DGAT activity. This would result in the production of MAG by the bifunctional GPAT/phosphatase which would then be converted to DAG by the MGAT and then TAG by a native DGAT or other activity. Novel DAG production could be confirmed and selected for by, for example, performing such a co-transformation in a yeast strain containing lethal SLC1+SLC4 knockouts such as that described by Benghezal et al. (2007; FIG. 2). FIG. 2 of Benghezal et al. (2007) shows that knocking out the two yeast LPATS (SLC1 & SLC4) is lethal. The SLC1+SLC4 double yeast mutant can only be maintained because of a complementing plasmid which provides one of the sic genes (SLC1 in their case) in trans. Negative selection by adding FOA to the medium results in the loss of this complementing plasmid (counterselection of the Ura selection marker) and renders the cells non viable.

In another embodiment of the invention, the vegetative plant part, transgenic non-human organism or part thereof, preferably a plant or seed, is co-transformed with chimeric DNAs encoding a bifunctional GPAT/phosphatase and a MGAT which has DGAT activity. This would result in the production of MAG by the bifunctional GPAT/phosphatase which would then be converted to DAG and then TAG by the MGAT.

In a further embodiment, one or more endogenous GPATs with no detectable phosphatase activity are silenced, for example one or more genes encoding GPATs that acylate glycerol-3-phosphate to form LPA in the Kennedy Pathway (for example, *Arabidopsis* GPAT1) is silenced.

In another embodiment, the vegetative plant part, transgenic non-human organism or part thereof, preferably a plant or seed, is transformed with a chimeric DNAs encoding a DGAT1, a DGAT2, a Wrinkled 1 (WRI1) transcription factor, an Oleosin, or a silencing suppressor polypeptide. The chimeric DNAs are preferably covalently linked on one DNA molecule such as, for example, a single T-DNA molecule, and the vegetative plant part, transgenic non-human organism or part thereof is preferably homozygous for the one DNA molecule inserted into its genome.

Substrate preferences could be engineered into the novel DAG and TAG synthesis pathways by, for example, supplying transgenic H1246 yeast strains expressing MGAT variants with a concentration of a particular free fatty acid (for example, DHA) that prevents complementation by the wild-type MGAT gene. Only the variants able to use the supplied free fatty acid would grow. Several cycles of MGAT engineering would result in the production of a MGAT with increased preference for particular fatty acids.

The various Kennedy Pathway complementations and supplementations described above could be performed in any cell type due to the ubiquitous nature of the initial substrate glycerol-3-phosphate. In one embodiment, the use of transgenes results in increased oil yields.

Polynucleotides

The terms "polynucleotide", and "nucleic acid" are used interchangeably. They refer to a polymeric form of nucleotides of any length, either deoxyribonucleotides or ribonucleotides, or analogs thereof. A polynucleotide of the invention may be of genomic, cDNA, semisynthetic, or synthetic origin, double-stranded or single-stranded and by virtue of its origin or manipulation: (1) is not associated with all or a portion of a polynucleotide with which it is associated in nature, (2) is linked to a polynucleotide other than that to which it is linked in nature, or (3) does not occur in nature. The following are non-limiting examples of polynucleotides: coding or non-coding regions of a gene or gene fragment, loci (locus) defined from linkage analysis, exons, introns, messenger RNA (mRNA), transfer RNA (tRNA), ribosomal RNA (rRNA), ribozymes, cDNA, recombinant polynucleotides, branched polynucleotides, plasmids, vectors, isolated DNA of any sequence, isolated RNA of any sequence, chimeric DNA of any sequence, nucleic acid probes, and primers. A polynucleotide may comprise modified nucleotides such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization such as by conjugation with a labeling component.

By "isolated polynucleotide" it is meant a polynucleotide which has generally been separated from the polynucleotide sequences with which it is associated or linked in its native state. Preferably, the isolated polynucleotide is at least 60% free, more preferably at least 75% free, and more preferably at least 90% free from the polynucleotide sequences with which it is naturally associated or linked.

As used herein, the term "gene" is to be taken in its broadest context and includes the deoxyribonucleotide sequences comprising the transcribed region and, if translated, the protein coding region, of a structural gene and including sequences located adjacent to the coding region on both the 5' and 3' ends for a distance of at least about 2 kb on either end and which are involved in expression of the gene. In this regard, the gene includes control signals such as promoters, enhancers, termination and/or polyadenylation signals that are naturally associated with a given gene, or heterologous control signals, in which case, the gene is referred to as a "chimeric gene". The sequences which are located 5' of the protein coding region and which are present on the mRNA are referred to as 5' non-translated sequences. The sequences which are located 3' or downstream of the protein coding region and which are present on the mRNA are referred to as 3' non-translated sequences. The term "gene" encompasses both cDNA and genomic forms of a gene. A genomic form or clone of a gene contains the coding region which may be interrupted with non-coding sequences termed "introns", "intervening regions", or "intervening sequences." Introns are segments of a gene which are transcribed into nuclear RNA (nRNA). Introns may contain regulatory elements such as enhancers. Introns are removed or "spliced out" from the nuclear or primary transcript; introns therefore are absent in the mRNA transcript. The mRNA functions during translation to specify the sequence or order of amino acids in a nascent polypeptide. The term "gene" includes a synthetic or fusion molecule encoding all or part of the proteins of the invention described herein and a complementary nucleotide sequence to any one of the above.

As used herein, "chimeric DNA" refers to any DNA molecule that is not naturally found in nature; also referred to herein as a "DNA construct". Typically, chimeric DNA comprises regulatory and transcribed or protein coding sequences that are not naturally found together in nature. Accordingly, chimeric DNA may comprise regulatory sequences and coding sequences that are derived from different sources, or regulatory sequences and coding sequences derived from the same source, but arranged in a manner different than that found in nature. The open reading frame may or may not be linked to its natural upstream and downstream regulatory elements. The open reading frame may be incorporated into, for example, the plant genome, in a non-natural location, or in a replicon or vector where it is not naturally found such as a bacterial plasmid or a viral vector. The term "chimeric DNA" is not limited to DNA molecules which are replicable in a host, but includes DNA capable of being ligated into a replicon by, for example, specific adaptor sequences.

A "transgene" is a gene that has been introduced into the genome by a transformation procedure. The term includes a gene in a progeny cell, plant, seed, non-human organism or part thereof which was introducing into the genome of a progenitor cell thereof. Such progeny cells etc may be at least a $3^{rd}$ or $4^{th}$ generation progeny from the progenitor cell which was the primary transformed cell. Progeny may be produced by sexual reproduction or vegetatively such as, for example, from tubers in potatoes or ratoons in sugarcane. The term "genetically modified", and variations thereof, is a broader term that includes introducing a gene into a cell by transformation or transduction, mutating a gene in a cell and genetically altering or modulating the regulation of a gene in a cell, or the progeny of any cell modified as described above.

A "genomic region" as used herein refers to a position within the genome where a transgene, or group of transgenes (also referred to herein as a cluster), have been inserted into a cell, or predecessor thereof. Such regions only comprise nucleotides that have been incorporated by the intervention of man such as by methods described herein.

A "recombinant polynucleotide" of the invention refers to a nucleic acid molecule which has been constructed or modified by artificial recombinant methods. The recombinant polynucleotide may be present in a cell in an altered amount or expressed at an altered rate (e.g., in the case of mRNA) compared to its native state. In one embodiment, the polynucleotide is introduced into a cell that does not naturally comprise the polynucleotide. Typically an exogenous DNA is used as a template for transcription of mRNA which is then translated into a continuous sequence of amino acid residues coding for a polypeptide of the invention within the transformed cell. In another embodiment, the polynucleotide is endogenous to the cell and its expression is altered by recombinant means, for example, an exogenous control sequence is introduced upstream of an endogenous gene of interest to enable the transformed cell to express the polypeptide encoded by the gene.

A recombinant polynucleotide of the invention includes polynucleotides which have not been separated from other components of the cell-based or cell-free expression system, in which it is present, and polynucleotides produced in said cell-based or cell-free systems which are subsequently purified away from at least some other components. The polynucleotide can be a contiguous stretch of nucleotides existing in nature, or comprise two or more contiguous stretches of nucleotides from different sources (naturally occurring and/or synthetic) joined to form a single polynucleotide. Typically, such chimeric polynucleotides comprise at least an open reading frame encoding a polypeptide of the invention operably linked to a promoter suitable of driving transcription of the open reading frame in a cell of interest.

With regard to the defined polynucleotides, it will be appreciated that % identity figures higher than those provided above will encompass preferred embodiments. Thus, where applicable, in light of the minimum % identity figures, it is preferred that the polynucleotide comprises a polynucleotide sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

A polynucleotide of, or useful for, the present invention may selectively hybridise, under stringent conditions, to a polynucleotide defined herein. As used herein, stringent conditions are those that: (1) employ during hybridisation a denaturing agent such as formamide, for example, 50% (v/v) formamide with 0.1% (w/v) bovine serum albumin, 0.1% Ficoll, 0.1% polyvinylpyrrolidone, 50 mM sodium phosphate buffer at pH 6.5 with 750 mM NaCl, 75 mM sodium citrate at 42° C.; or (2) employ 50% formamide, 5×SSC (0.75 M NaCl, 0.075 M sodium citrate), 50 mM sodium phosphate (pH 6.8), 0.1% sodium pyrophosphate, 5×Denhardt's solution, sonicated salmon sperm DNA (50 g/ml), 0.1% SDS and 10% dextran sulfate at 42° C. in 0.2×SSC and 0.1% SDS, and/or (3) employ low ionic strength and high temperature for washing, for example, 0.015 M NaCl/0.0015 M sodium citrate/0.1% SDS at 50° C.

Polynucleotides of the invention may possess, when compared to naturally occurring molecules, one or more mutations which are deletions, insertions, or substitutions of nucleotide residues. Polynucleotides which have mutations relative to a reference sequence can be either naturally occurring (that is to say, isolated from a natural source) or synthetic (for example, by performing site-directed mutagenesis or DNA shuffling on the nucleic acid as described above).

Polynucleotide for Reducing Expression Levels of Endogenous Proteins

RNA Interference

RNA interference (RNAi) is particularly useful for specifically inhibiting the production of a particular protein. Although not wishing to be limited by theory, Waterhouse et al. (1998) have provided a model for the mechanism by which dsRNA (duplex RNA) can be used to reduce protein production. This technology relies on the presence of dsRNA molecules that contain a sequence that is essentially identical to the mRNA of the gene of interest or part thereof. Conveniently, the dsRNA can be produced from a single promoter in a recombinant vector or host cell, where the sense and anti-sense sequences are flanked by an unrelated sequence which enables the sense and anti-sense sequences to hybridize to form the dsRNA molecule with the unrelated sequence forming a loop structure. The design and production of suitable dsRNA molecules is well within the capacity of a person skilled in the art, particularly considering Waterhouse et al. (1998), Smith et al. (2000), WO 99/32619, WO 99/53050, WO 99/49029, and WO 01/34815.

In one example, a DNA is introduced that directs the synthesis of an at least partly double stranded RNA products) with homology to the target gene to be inactivated. The DNA therefore comprises both sense and antisense sequences that, when transcribed into RNA, can hybridize to form the double stranded RNA region. In one embodiment of the invention, the sense and antisense sequences are separated by a spacer region that comprises an intron which, when transcribed into RNA, is spliced out. This arrangement has been shown to result in a higher efficiency of gene silencing. The double stranded region may comprise one or two RNA molecules, transcribed from either one DNA region or two. The presence of the double stranded molecule is thought to trigger a response from an endogenous system that destroys both the double stranded RNA and also the homologous RNA transcript from the target gene, efficiently reducing or eliminating the activity of the target gene.

The length of the sense and antisense sequences that hybridize should each be at least 19 contiguous nucleotides. The full-length sequence corresponding to the entire gene transcript may be used. The degree of identity of the sense and antisense sequences to the targeted transcript should be at least 85%, at least 90%, or at least 95-100%. The RNA molecule may of course comprise unrelated sequences which may function to stabilize the molecule. The RNA molecule may be expressed under the control of a RNA polymerase II or RNA polymerase III promoter. Examples of the latter include tRNA or snRNA promoters.

Preferred small interfering RNA ("siRNA") molecules comprise a nucleotide sequence that is identical to about 19-21 contiguous nucleotides of the target mRNA. Preferably, the siRNA sequence commences with the dinucleotide AA, comprises a GC-content of about 30-70% (preferably, 30-60%, more preferably 40-60% and more preferably about 45%-55%), and does not have a high percentage identity to any nucleotide sequence other than the target in the genome of the organism in which it is to be introduced, for example, as determined by standard BLAST search.

microRNA

MicroRNAs (abbreviated miRNAs) are generally 19-25 nucleotides (commonly about 20-24 nucleotides in plants) non-coding RNA molecules that are derived from larger precursors that form imperfect stem-loop structures.

miRNAs bind to complementary sequences on target messenger RNA transcripts (mRNAs), usually resulting in translational repression or target degradation and gene silencing.

In plant cells, miRNA precursor molecules are believed to be largely processed in the nucleus. The pri-miRNA (containing one or more local double-stranded or "hairpin" regions as well as the usual 5' "cap" and polyadenylated tail of an mRNA) is processed to a shorter miRNA precursor molecule that also includes a stem-loop or fold-back structure and is termed the "pre-miRNA". In plants, the pre-miRNAs are cleaved by distinct DICER-like (DCL) enzymes, yielding miRNA:miRNA*duplexes. Prior to transport out of the nucleus, these duplexes are methylated.

In the cytoplasm, the miRNA strand from the miRNA: miRNA duplex is selectively incorporated into an active RNA-induced silencing complex (RISC) for target recognition. The RISC— complexes contain a particular subset of Argonaute proteins that exert sequence-specific gene repression (see, for example, Millar and Waterhouse, 2005; Pasquinelli et al., 2005; Almeida and Allshire, 2005).

Cosuppression

Genes can suppress the expression of related endogenous genes and/or transgenes already present in the genome, a phenomenon termed homology-dependent gene silencing. Most of the instances of homologydependent gene silencing fall into two classes—those that function at the level of transcription of the transgene, and those that operate post-transcriptionally.

Post-transcriptional homology-dependent gene silencing (i.e., cosuppression) describes the loss of expression of a transgene and related endogenous or viral genes in transgenic plants. Cosuppression often, but not always, occurs when transgene transcripts are abundant, and it is generally thought to be triggered at the level of mRNA processing, localization, and/or degradation. Several models exist to explain how cosuppression works (see in Taylor, 1997).

One model, the "quantitative" or "RNA threshold" model, proposes that cells can cope with the accumulation of large amounts of transgene transcripts, but only up to a point. Once that critical threshold has been crossed, the sequence-dependent degradation of both transgene and related endogenous gene transcripts is initiated. It has been proposed that this mode of cosuppression may be triggered following the synthesis of copy RNA (cRNA) molecules by reverse transcription of the excess transgene mRNA, presumably by endogenous RNA-dependent RNA polymerases. These cRNAs may hybridize with transgene and endogenous mRNAs, the unusual hybrids targeting homologous transcripts for degradation. However, this model does not account for reports suggesting that cosuppression can apparently occur in the absence of transgene transcription and/or without the detectable accumulation of transgene transcripts.

To account for these data, a second model, the "qualitative" or "aberrant RNA" model, proposes that interactions between transgene RNA and DNA and/or between endogenous and introduced DNAs lead to the methylation of transcribed regions of the genes. The methylated genes are proposed to produce RNAs that are in some way aberrant, their anomalous features triggering the specific degradation of all related transcripts. Such aberrant RNAs may be produced by complex transgene loci, particularly those that contain inverted repeats.

A third model proposes that intermolecular base pairing between transcripts, rather than cRNA-mRNA hybrids generated through the action of an RNA-dependent RNA polymerase, may trigger cosuppression. Such base pairing may become more common as transcript levels rise, the putative double-stranded regions triggering the targeted degradation of homologous transcripts. A similar model proposes intramolecular base pairing instead of intermolecular base pairing between transcripts.

Cosuppression involves introducing an extra copy of a gene or a fragment thereof into a plant in the sense orientation with respect to a promoter for its expression. A skilled person would appreciate that the size of the sense fragment, its correspondence to target gene regions, and its degree of sequence identity to the target gene can vary. In some instances, the additional copy of the gene sequence interferes with the expression of the target plant gene. Reference is made to WO 97/20936 and EP 0465572 for methods of implementing co-suppression approaches.

Antisense Polynucleotides

The term "antisense polynucleotide" shall be taken to mean a DNA or RNA, or combination thereof, molecule that is complementary to at least a portion of a specific mRNA molecule encoding an endogenous polypeptide and capable of interfering with a post-transcriptional event such as mRNA translation. The use of antisense methods is well known in the art (see for example, G. Hartmann and S. Endres, Manual of Antisense Methodology, Kluwer (1999)). The use of antisense techniques in plants has been reviewed by Bourque (1995) and Senior (1998). Bourque (1995) lists a large number of examples of how antisense sequences have been utilized in plant systems as a method of gene inactivation. Bourque also states that attaining 100% inhibition of any enzyme activity may not be necessary as partial inhibition will more than likely result in measurable change in the system. Senior (1998) states that antisense methods are now a very well established technique for manipulating gene expression.

In one embodiment, the antisense polynucleotide hybridises under physiological conditions, that is, the antisense polynucleotide (which is fully or partially single stranded) is at least capable of forming a double stranded polynucleotide with mRNA encoding a protein such as an endogenous enzyme, for example, DGAT, GPAT, LPAA, LPCAT, PAP, AGPase, under normal conditions in a cell.

Antisense molecules may include sequences that correspond to the structural genes or for sequences that effect control over the gene expression or splicing event. For example, the antisense sequence may correspond to the targeted coding region of endogenous gene, or the 5'-untranslated region (UTR) or the 3'-UTR or combination of these. It may be complementary in part to intron sequences, which may be spliced out during or after transcription, preferably only to exon sequences of the target gene. In view of the generally greater divergence of the UTRs, targeting these regions provides greater specificity of gene inhibition.

The length of the antisense sequence should be at least 19 contiguous nucleotides, preferably at least 50 nucleotides, and more preferably at least 100, 200, 500 or 1000 nucleotides. The full-length sequence complementary to the entire gene transcript may be used. The length is most preferably 100-2000 nucleotides. The degree of identity of the antisense sequence to the targeted transcript should be at least 90% and more preferably 95-100%. The antisense RNA molecule may of course comprise unrelated sequences which may function to stabilize the molecule.

Catalytic Polynucleotides

The term "catalytic polynucleotide" refers to a DNA molecule or DNA-containing molecule (also known in the art as a "deoxyribozyme") or an RNA or RNA-containing molecule (also known as a "ribozyme") which specifically recognizes a distinct substrate and catalyses the chemical modification of this substrate. The nucleic acid bases in the catalytic nucleic acid can be bases A, C, G, T (and U for RNA).

Typically, the catalytic nucleic acid contains an antisense sequence for specific recognition of a target nucleic acid, and a nucleic acid cleaving enzymatic activity (also referred to herein as the "catalytic domain"). The types of ribozymes that are particularly useful in this invention are hammerhead ribozymes (Haseloff and Gerlach, 1988; Perriman et al., 1992) and hairpin ribozymes (Zolotukhin et al., 1996; Klein et al., 1998; Shippy et al., 1999).

Ribozymes useful in the invention and DNA encoding the ribozymes can be chemically synthesized using methods well known in the art. The ribozymes can also be prepared from a DNA molecule (that upon transcription, yields an RNA molecule) operably linked to an RNA polymerase promoter, for example, the promoter for T7 RNA polymerase or SP6 RNA polymerase. In a separate embodiment, the DNA can be inserted into an expression cassette or transcription cassette. After synthesis, the RNA molecule can be modified by ligation to a DNA molecule having the ability to stabilize the ribozyme and make it resistant to RNase.

As with antisense oligonucleotides, small interfering RNA and microRNA described herein, catalytic polynucleotides useful in the invention should be capable of "hybridizing" the target nucleic acid molecule under "physiological conditions", namely those conditions within a plant, algal or fungal cell.

Recombinant Vectors

One embodiment of the present invention includes a recombinant vector, which comprises at least one polynucleotide defined herein and is capable of delivering the polynucleotide into a host cell. Recombinant vectors include expression vectors. Recombinant vectors contain heterologous polynucleotide sequences, that is, polynucleotide sequences that are not naturally found adjacent to a polynucleotide defined herein, that preferably, are derived from a different species. The vector can be either RNA or DNA, either prokaryotic or eukaryotic, and typically is a viral vector, derived from a virus, or a plasmid. Plasmid vectors typically include additional nucleic acid sequences that provide for easy selection, amplification, and transformation of the expression cassette in prokaryotic cells, e.g., pUC-derived vectors, pSK-derived vectors, pGEM-derived vectors, pSP-derived vectors, pBS-derived vectors, or binary vectors containing one or more T-DNA regions. Additional nucleic acid sequences include origins of replication to provide for autonomous replication of the vector, selectable marker genes, preferably encoding antibiotic or herbicide resistance, unique multiple cloning sites providing for multiple sites to insert nucleic acid sequences or genes encoded in the nucleic acid construct, and sequences that enhance transformation of prokaryotic and eukaryotic (especially plant) cells.

"Operably linked" as used herein, refers to a functional relationship between two or more nucleic acid (e.g., DNA) segments. Typically, it refers to the functional relationship of transcriptional regulatory element (promoter) to a transcribed sequence. For example, a promoter is operably linked to a coding sequence of a polynucleotide defined herein, if it stimulates or modulates the transcription of the coding sequence in an appropriate cell. Generally, promoter transcriptional regulatory elements that are operably linked to a transcribed sequence are physically contiguous to the transcribed sequence, i.e., they are cis-acting. However, some transcriptional regulatory elements such as enhancers, need not be physically contiguous or located in close proximity to the coding sequences whose transcription they enhance.

When there are multiple promoters present, each promoter may independently be the same or different.

Recombinant vectors may also contain: (a) one or more secretory signals which encode signal peptide sequences, to enable an expressed polypeptide defined herein to be secreted from the cell that produces the polypeptide, or which provide for localisation of the expressed polypeptide, for example, for retention of the polypeptide in the endoplasmic reticulum (ER) in the cell, or transfer into a plastid, and/or (b) contain fusion sequences which lead to the expression of nucleic acid molecules as fusion proteins. Examples of suitable signal segments include any signal segment capable of directing the secretion or localisation of a polypeptide defined herein. Preferred signal segments include, but are not limited to, *Nicotiana nectarin* signal peptide (U.S. Pat. No. 5,939,288), tobacco extension signal, or the soy oleosin oil body binding protein signal. Recombinant vectors may also include intervening and/or untranslated sequences surrounding and/or within the nucleic acid sequence of a polynucleotide defined herein.

To facilitate identification of transformants, the recombinant vector desirably comprises a selectable or screenable marker gene as, or in addition to, the nucleic acid sequence of a polynucleotide defined herein. By "marker gene" is meant a gene that imparts a distinct phenotype to cells expressing the marker gene and thus, allows such transformed cells to be distinguished from cells that do not have the marker. A selectable marker gene confers a trait for which one can "select" based on resistance to a selective agent (e.g., a herbicide, antibiotic, radiation, heat, or other treatment damaging to untransformed cells). A screenable marker gene (or reporter gene) confers a trait that one can identify through observation or testing, that is, by "screening" (e.g., β-glucuronidase, luciferase, GFP or other enzyme activity not present in untransformed cells). The marker gene and the nucleotide sequence of interest do not have to be linked, since co-transformation of unlinked genes as for example, described in U.S. Pat. No. 4,399,216, is also an efficient process in for example, plant transformation. The actual choice of a marker is not crucial as long as it is functional (i.e., selective) in combination with the cells of choice such as a plant cell.

Examples of bacterial selectable markers are markers that confer antibiotic resistance such as ampicillin, erythromycin, chloramphenicol, or tetracycline resistance, preferably kanamycin resistance. Exemplary selectable markers for selection of plant transformants include, but are not limited to, a hyg gene which encodes hygromycin B resistance; a neomycin phosphotransferase (nptII) gene conferring resistance to kanamycin, paromomycin, G418; a glutathione-S-transferase gene from rat liver conferring resistance to glutathione derived herbicides as for example, described in EP 256223; a glutamine synthetase gene conferring, upon overexpression, resistance to glutamine synthetase inhibitors such as phosphinothricin as for example, described in WO 87/05327; an acetyltransferase gene from *Streptomyces viridochromogenes* conferring resistance to the selective agent phosphinothricin as for example, described in EP 275957; a gene encoding a 5-enolshikimate-3-phosphate synthase (EPSPS) conferring tolerance to N-phosphonomethylglycine as for example, described by Hinchee et al. (1988); a bar gene conferring resistance against bialaphos as for example, described in WO91/02071; a nitrilase gene such as bxn from *Klebsiella ozaenae* which confers resistance to bromoxynil (Stalker et al., 1988); a dihydrofolate reductase (DHFR) gene conferring resistance to methotrexate (Thillet et al., 1988); a mutant acetolactate synthase gene (ALS) which confers resistance to imidazolinone, sulfonylurea, or other ALS-inhibiting chemicals (EP 154,204); a mutated anthranilate synthase gene that confers resistance to 5-methyl tryptophan; or a dalapon dehalogenase gene that confers resistance to the herbicide.

Preferred screenable markers include, but are not limited to, a uidA gene encoding a β-glucuronidase (GUS) enzyme for which various chromogenic substrates are known; a β-galactosidase gene encoding an enzyme for which chromogenic substrates are known; an aequorin gene (Prasher et al., 1985)

which may be employed in calcium-sensitive bioluminescence detection; a green fluorescent protein gene (Niedz et al., 1995) or derivatives thereof; or a luciferase (luc) gene (Ow et al., 1986) which allows for bioluminescence detection. By "reporter molecule" it is meant a molecule that, by its chemical nature, provides an analytically identifiable signal that facilitates determination of promoter activity by reference to protein product.

Preferably, the recombinant vector is stably incorporated into the genome of the cell such as the plant cell. Accordingly, the recombinant vector may comprise appropriate elements which allow the vector to be incorporated into the genome, or into a chromosome of the cell.

Expression Vector

As used herein, an "expression vector" is a DNA or RNA vector that is capable of transforming a host cell and of effecting expression of one or more specified polynucleotides. Preferably, the expression vector is also capable of replicating within the host cell. Expression vectors can be either prokaryotic or eukaryotic, and are typically viruses or plasmids. Expression vectors of the present invention include any vectors that function (i.e., direct gene expression) in host cells of the present invention, including in bacterial, fungal, endoparasite, arthropod, animal, algal, and plant cells. Particularly preferred expression vectors of the present invention can direct gene expression in yeast, algae and/or plant cells.

Expression vectors of the present invention contain regulatory sequences such as transcription control sequences, translation control sequences, origins of replication, and other regulatory sequences that are compatible with the host cell and that control the expression of polynucleotides of the present invention. In particular, expression vectors of the present invention include transcription control sequences. Transcription control sequences are sequences which control the initiation, elongation, and termination of transcription. Particularly important transcription control sequences are those which control transcription initiation such as promoter, enhancer, operator and repressor sequences. Suitable transcription control sequences include any transcription control sequence that can function in at least one of the recombinant cells of the present invention. The choice of the regulatory sequences used depends on the target organism such as a plant and/or target organ or tissue of interest. Such regulatory sequences may be obtained from any eukaryotic organism such as plants or plant viruses, or may be chemically synthesized. A variety of such transcription control sequences are known to those skilled in the art. Particularly preferred transcription control sequences are promoters active in directing transcription in plants, either constitutively or stage and/or tissue specific, depending on the use of the plant or part(s) thereof.

A number of vectors suitable for stable transfection of plant cells or for the establishment of transgenic plants have been described in for example, Pouwels et al., Cloning Vectors: A Laboratory Manual, 1985, supp. 1987, Weissbach and Weissbach, Methods for Plant Molecular Biology, Academic Press, 1989, and Gelvin et al., Plant Molecular Biology Manual, Kluwer Academic Publishers, 1990. Typically, plant expression vectors include for example, one or more cloned plant genes under the transcriptional control of 5' and 3' regulatory sequences and a dominant selectable marker. Such plant expression vectors also can contain a promoter regulatory region (e.g., a regulatory region controlling inducible or constitutive, environmentally- or developmentally-regulated, or cell- or tissue-specific expression), a transcription initiation start site, a ribosome binding site, an RNA processing signal, a transcription termination site, and/or a polyadenylation signal.

A number of constitutive promoters that are active in plant cells have been described. Suitable promoters for constitutive expression in plants include, but are not limited to, the cauliflower mosaic virus (CaMV) 35S promoter, the Figwort mosaic virus (FMV) 35S, the sugarcane bacilliform virus promoter, the commelina yellow mottle virus promoter, the light-inducible promoter from the small subunit of the ribulose-1,5-bis-phosphate carboxylase, the rice cytosolic triosephosphate isomerase promoter, the adenine phosphoribosyltransferase promoter of *Arabidopsis*, the rice actin 1 gene promoter, the mannopine synthase and octopine synthase promoters, the Adh promoter, the sucrose synthase promoter, the R gene complex promoter, and the chlorophyll $\alpha/\beta$ binding protein gene promoter. These promoters have been used to create DNA vectors that have been expressed in plants, see for example, WO 84/02913. All of these promoters have been used to create various types of plant-expressible recombinant DNA vectors.

For the purpose of expression in source tissues of the plant such as the leaf, seed, root or stem, it is preferred that the promoters utilized in the present invention have relatively high expression in these specific tissues. For this purpose, one may choose from a number of promoters for genes with tissue- or cell-specific, or -enhanced expression. Examples of such promoters reported in the literature include, the chloroplast glutamine synthetase GS2 promoter from pea, the chloroplast fructose-1,6-biphosphatase promoter from wheat, the nuclear photosynthetic ST-LS1 promoter from potato, the serine/threonine kinase promoter and the glucoamylase (CHS) promoter from *Arabidopsis thaliana*. Also reported to be active in photosynthetically active tissues are the ribulose-1,5-bisphosphate carboxylase promoter from eastern larch (*Larix laricina*), the promoter for the Cab gene, Cab6, from pine, the promoter for the Cab-1 gene from wheat, the promoter for the Cab-1 gene from spinach, the promoter for the Cab 1R gene from rice, the pyruvate, orthophosphate dikinase (PPDK) promoter from *Zea mays*, the promoter for the tobacco Lhcb1*2 gene, the *Arabidopsis thaliana* Suc2 sucrose-$H^{30}$ symporter promoter, and the promoter for the thylakoid membrane protein genes from spinach (PsaD, PsaF, PsaE, PC, FNR, AtpC, AtpD, Cab, RbcS). Other promoters for the chlorophyll $\alpha/\beta$-binding proteins may also be utilized in the present invention such as the promoters for LhcB gene and PsbP gene from white mustard (*Sinapis alba*).

A variety of plant gene promoters that are regulated in response to environmental, hormonal, chemical, and/or developmental signals, also can be used for expression of RNA-binding protein genes in plant cells, including promoters regulated by (1) heat, (2) light (e.g., pea RbcS-3A promoter, maize RbcS promoter), (3) hormones such as abscisic acid, (4) wounding (e.g., Wun1), or (5) chemicals such as methyl jasmonate, salicylic acid, steroid hormones, alcohol, Safeners (WO 97/06269), or it may also be advantageous to employ (6) organ-specific promoters.

As used herein, the term "plant storage organ specific promoter" refers to a promoter that preferentially, when compared to other plant tissues, directs gene transcription in a storage organ of a plant. Preferably, the promoter only directs expression of a gene of interest in the storage organ, and/or expression of the gene of interest in other parts of the plant such as leaves is not detectable by Northern blot analysis and/or RT-PCR. Typically, the promoter drives expression of genes during growth and development of the storage organ, in particular during the phase of synthesis and accumulation of storage compounds in the storage organ. Such promoters may drive gene expression in the entire plant storage organ or only part thereof such as the seedcoat, embryo or cotyledon(s) in seeds of dicotyledonous plants or the endosperm or aleurone layer of seeds of monocotyledonous plants.

For the purpose of expression in sink tissues of the plant such as the tuber of the potato plant, the fruit of tomato, or the seed of soybean, canola, cotton, Zea mays, wheat, rice, and barley, it is preferred that the promoters utilized in the present invention have relatively high expression in these specific tissues. A number of promoters for genes with tuber-specific or -enhanced expression are known, including the class I patatin promoter, the promoter for the potato tuber ADPGPP genes, both the large and small subunits, the sucrose synthase promoter, the promoter for the major tuber proteins, including the 22 kD protein complexes and proteinase inhibitors, the promoter for the granule bound starch synthase gene (GBSS), and other class I and II patatins promoters. Other promoters can also be used to express a protein in specific tissues such as seeds or fruits. The promoter for 13-conglycinin or other seed-specific promoters such as the napin, zein, linin and phaseolin promoters, can be used. Root specific promoters may also be used. An example of such a promoter is the promoter for the acid chitinase gene. Expression in root tissue could also be accomplished by utilizing the root specific subdomains of the CaMV 35S promoter that have been identified.

In a particularly preferred embodiment, the promoter directs expression in tissues and organs in which lipid biosynthesis take place. Such promoters may act in seed development at a suitable time for modifying lipid composition in seeds.

In an embodiment, the promoter is a plant storage organ specific promoter. In one embodiment, the plant storage organ specific promoter is a seed specific promoter. In a more preferred embodiment, the promoter preferentially directs expression in the cotyledons of a dicotyledonous plant or in the endosperm of a monocotyledonous plant, relative to expression in the embryo of the seed or relative to other organs in the plant such as leaves. Preferred promoters for seed-specific expression include: 1) promoters from genes encoding enzymes involved in lipid biosynthesis and accumulation in seeds such as desaturases and elongases, 2) promoters from genes encoding seed storage proteins, and 3) promoters from genes encoding enzymes involved in carbohydrate biosynthesis and accumulation in seeds. Seed specific promoters which are suitable are, the oilseed rape napin gene promoter (U.S. Pat. No. 5,608,152), the *Vicia faba* USP promoter (Baumlein et al., 1991), the *Arabidopsis* oleosin promoter (WO 98/45461), the *Phaseolus vulgaris* phaseolin promoter (U.S. Pat. No. 5,504,200), the *Brassica* Bce4 promoter (WO 91/13980), or the legumin B4 promoter (Baumlein et al., 1992), and promoters which lead to the seed-specific expression in monocots such as maize, barley, wheat, rye, rice and the like. Notable promoters which are suitable are the barley lpt2 or lpt1 gene promoter (WO 95/15389 and WO 95/23230), or the promoters described in WO 99/16890 (promoters from the barley hordein gene, the rice glutelin gene, the rice oryzin gene, the rice prolamin gene, the wheat gliadin gene, the wheat glutelin gene, the maize zein gene, the oat glutelin gene, the sorghum kasirin gene, the rye secalin gene). Other promoters include those described by Broun et al. (1998), Potenza et al. (2004), US 20070192902 and US 20030159173. In an embodiment, the seed specific promoter is preferentially expressed in defined parts of the seed such as the cotyledon(s) or the endosperm. Examples of cotyledon specific promoters include, but are not limited to, the FP1 promoter (Ellerstrom et al., 1996), the pea legumin promoter (Perrin et al., 2000), and the bean phytohemagglutnin promoter (Perrin et al., 2000). Examples of endosperm specific promoters include, but are not limited to, the maize zein-1 promoter (Chikwamba et al., 2003), the rice glutelin-1 promoter (Yang et al., 2003), the barley D-hordein promoter (Horvath et al., 2000) and wheat HMW glutenin promoters (Alvarez et al., 2000). In a further embodiment, the seed specific promoter is not expressed, or is only expressed at a low level, in the embryo and/or after the seed germinates.

In another embodiment, the plant storage organ specific promoter is a tuber specific promoter. Examples include, but are not limited to, the potato patatin B33, PAT21 and GBSS promoters, as well as the sweet potato sporamin promoter (for review, see Potenza et al., 2004). In a preferred embodiment, the promoter directs expression preferentially in the pith of the tuber, relative to the outer layers (skin, bark) or the embryo of the tuber.

In another embodiment, the plant storage organ specific promoter is a fruit specific promoter. Examples include, but are not limited to, the tomato polygalacturonase, E8 and Pds promoters, as well as the apple ACC oxidase promoter (for review, see Potenza et al., 2004). In a preferred embodiment, the promoter preferentially directs expression in the edible parts of the fruit, for example the pith of the fruit, relative to the skin of the fruit or the seeds within the fruit.

In an embodiment, the inducible promoter is the *Aspergillus nidulans* alc system. Examples of inducible expression systems which can be used instead of the *Aspergillus nidulans* alc system are described in a review by Padidam (2003) and Corrado and Karali (2009). These include tetracycline repressor (TetR)-based and tetracycline inducible systems (Gatz, 1997), tetracycline repressor-based and tetracycline-inactivatable systems (Weinmann et al., 1994), glucocorticoid receptor-based (Picard, 1994), estrogen receptor-based and other steroid-inducible systems systems (Bruce et al., 2000), glucocorticoid receptor-, tetracycline repressor-based dual control systems (Bohner et al., 1999), ecdysone receptor-based, insecticide-inducible systems (Martinez et al., 1999, Padidam et al., 2003, Unger et al, 2002, Riddiford et al., 2000, Dhadialla et al., 1998, Martinez and Jepson, 1999), AlcR-based, ethanol-inducible systems (Felenbok, 1991) and ACEI-based, copper-inducible systems (Mett et al., 1993).

In another embodiment, the inducible promoter is a safener inducible promoter such as, for example, the maize ln2-1 or ln2-2 promoter (Hershey and Stoner, 1991), the safener inducible promoter is the maize GST-27 promoter (Jepson et al., 1994), or the soybean GH2/4 promoter (Ulmasov et al., 1995).

Safeners are a group of structurally diverse chemicals used to increase the plant's tolerance to the toxic effects of an herbicidal compound. Examples of these compounds include naphthalic anhydride and N,N-diallyl-2,2-dichloroacetamide (DDCA), which protect maize and sorghum against thiocarbamate herbicides; cyometrinil, which protects sorghum against metochlor; triapenthenol, which protects soybeans against metribuzin; and substituted benzenesulfonamides, which improve the tolerance of several cereal crop species to sulfonylurea herbicides.

In another embodiment, the inducible promoter is a senescence inducible promoter such as, for example, senescence-inducible promoter SAG (senescence associated gene) 12 and SAG 13 from *Arabidopsis* (Gan, 1995; Gan and Amasino, 1995) and LSC54 from *Brassica napus* (Buchanan-Wollaston, 1994).

For expression in vegetative tissue leaf-specific promoters, such as the ribulose biphosphate carboxylase (RBCS) promoters, can be used. For example, the tomato RBCS1, RBCS2 and RBCS3A genes are expressed in leaves and light grown seedlings (Meier et al., 1997). A ribulose bisphosphate carboxylase promoters expressed almost exclusively in mesophyll cells in leaf blades and leaf sheaths at high levels, described by Matsuoka et al. (1994), can be used. Another leaf-specific promoter is the light harvesting chlorophyll a/b binding protein gene promoter (see, Shiina et al., 1997). The *Arabidopsis thaliana* myb-related gene promoter (Atmyb5) described by Li et al. (1996), is leaf-specific. The Atmyb5 promoter is expressed in developing leaf trichomes, stipules, and epidermal cells on the margins of young rosette and cauline leaves, and in immature seeds. A leaf promoter identified in maize by Busk et al. (1997), can also be used.

In some instances, for example when LEC2 or BBM is recombinantly expressed, it may be desirable that the transgene is not expressed at high levels. An example of a promoter which can be used in such circumstances is a truncated napin A promoter which retains the seed-specific expression pattern but with a reduced expression level (Tan et al., 2011).

The 5' non-translated leader sequence can be derived from the promoter selected to express the heterologous gene sequence of the polynucleotide of the present invention, or may be heterologous with respect to the coding region of the enzyme to be produced, and can be specifically modified if desired so as to increase translation of mRNA. For a review of optimizing expression of transgenes, see Koziel et al. (1996). The 5' non-translated regions can also be obtained from plant viral RNAs (Tobacco mosaic virus, Tobacco etch virus, Maize dwarf mosaic virus, Alfalfa mosaic virus, among others) from suitable eukaryotic genes, plant genes (wheat and maize chlorophyll a/b binding protein gene leader), or from a synthetic gene sequence. The present invention is not limited to constructs wherein the non-translated region is derived from the 5' non-translated sequence that accompanies the promoter sequence. The leader sequence could also be derived from an unrelated promoter or coding sequence. Leader sequences useful in context of the present invention comprise the maize Hsp70 leader (U.S. Pat. No. 5,362,865 and U.S. Pat. No. 5,859,347), and the TMV omega element.

The termination of transcription is accomplished by a 3' non-translated DNA sequence operably linked in the expression vector to the polynucleotide of interest. The 3' non-translated region of a recombinant DNA molecule contains a polyadenylation signal that functions in plants to cause the addition of adenylate nucleotides to the 3' end of the RNA. The 3' non-translated region can be obtained from various genes that are expressed in plant cells. The nopaline synthase 3' untranslated region, the 3' untranslated region from pea small subunit Rubisco gene, the 3' untranslated region from soybean 7S seed storage protein gene are commonly used in this capacity. The 3' transcribed, non-translated regions containing the polyadenylate signal of *Agrobacterium* tumor-inducing (Ti) plasmid genes are also suitable.

Recombinant DNA technologies can be used to improve expression of a transformed polynucleotide by manipulating for example, the number of copies of the polynucleotide within a host cell, the efficiency with which those polynucleotide are transcribed, the efficiency with which the resultant transcripts are translated, and the efficiency of post-translational modifications. Recombinant techniques useful for increasing the expression of polynucleotides defined herein include, but are not limited to, operatively linking the polynucleotide to a high-copy number plasmid, integration of the polynucleotide molecule into one or more host cell chromosomes, addition of vector stability sequences to the plasmid, substitutions or modifications of transcription control signals (e.g., promoters, operators, enhancers), substitutions or modifications of translational control signals (e.g., ribosome binding sites, Shine-Dalgarno sequences), modification of the polynucleotide to correspond to the codon usage of the host cell, and the deletion of sequences that destabilize transcripts.

Transfer Nucleic Acids

Transfer nucleic acids can be used to deliver an exogenous polynucleotide to a cell and comprise one, preferably two, border sequences and a polynucleotide of interest. The transfer nucleic acid may or may not encode a selectable marker. Preferably, the transfer nucleic acid forms part of a binary vector in a bacterium, where the binary vector further comprises elements which allow replication of the vector in the bacterium, selection, or maintenance of bacterial cells containing the binary vector. Upon transfer to a eukaryotic cell, the transfer nucleic acid component of the binary vector is capable of integration into the genome of the eukaryotic cell.

As used herein, the term "extrachromosomal transfer nucleic acid" refers to a nucleic acid molecule that is capable of being transferred from a bacterium such as *Agrobacterium* sp., to a eukaryotic cell such as a plant leaf cell. An extrachromosomal transfer nucleic acid is a genetic element that is well-known as an element capable of being transferred, with the subsequent integration of a nucleotide sequence contained within its borders into the genome of the recipient cell. In this respect, a transfer nucleic acid is flanked, typically, by two "border" sequences, although in some instances a single border at one end can be used and the second end of the transferred nucleic acid is generated randomly in the transfer process. A polynucleotide of interest is typically positioned between the left border-like sequence and the right border-like sequence of a transfer nucleic acid. The polynucleotide contained within the transfer nucleic acid may be operably linked to a variety of different promoter and terminator regulatory elements that facilitate its expression, that is, transcription and/or translation of the polynucleotide. Transfer DNAs (T-DNAs) from *Agrobacterium* sp. such as *Agrobacterium tumefaciens* or *Agrobacterium rhizogenes*, and man made variants/mutants thereof are probably the best characterized examples of transfer nucleic acids. Another example is P-DNA ("plant-DNA") which comprises T-DNA border-like sequences from plants.

As used herein, "T-DNA" refers to for example, T-DNA of an *Agrobacterium tumefaciens* Ti plasmid or from an *Agrobacterium rhizogenes* Ri plasmid, or man made variants thereof which function as T-DNA. The T-DNA may comprise an entire T-DNA including both right and left border sequences, but need only comprise the minimal sequences required in cis for transfer, that is, the right and T-DNA border sequence. The T-DNAs of the invention have inserted into them, anywhere between the right and left border sequences (if present), the polynucleotide of interest flanked by target sites for a site-specific recombinase. The sequences encoding factors required in trans for transfer of the T-DNA into a plant cell such as vir genes, may be inserted into the T-DNA, or may be present on the same replicon as the T-DNA, or preferably are in trans on a compatible replicon in the *Agrobacterium* host. Such "binary vector systems" are well known in the art.

As used herein, "P-DNA" refers to a transfer nucleic acid isolated from a plant genome, or man made variants/mutants thereof, and comprises at each end, or at only one end, a T-DNA border-like sequence. The border-like sequence preferably shares at least 50%, at least 60%, at least 70%, at least 75%, at least 80%, at least 90% or at least 95%, but less than 100% sequence identity, with a T-DNA border sequence from an *Agrobacterium* sp. such as *Agrobacterium tumefaciens* or

*Agrobacterium rhizogenes*. Thus, P-DNAs can be used instead of T-DNAs to transfer a nucleotide sequence contained within the P-DNA from, for example *Agrobacterium*, to another cell. The P-DNA, before insertion of the exogenous polynucleotide which is to be transferred, may be modified to facilitate cloning and should preferably not encode any proteins. The P-DNA is characterized in that it contains, at least a right border sequence and preferably also a left border sequence.

As used herein, a "border" sequence of a transfer nucleic acid can be isolated from a selected organism such as a plant or bacterium, or be a man made variant/mutant thereof. The border sequence promotes and facilitates the transfer of the polynucleotide to which it is linked and may facilitate its integration in the recipient cell genome. In an embodiment, a border-sequence is between 5-100 base pairs (bp) in length, 10-80 bp in length, 15-75 bp in length, 15-60 bp in length, 15-50 by in length, 15-40 bp in length, 15-30 bp in length, 16-30 bp in length, 20-30 bp in length, 21-30 bp in length, 22-30 bp in length, 23-30 bp in length, 24-30 bp in length, 25-30 bp in length, or 26-30 bp in length. Border sequences from T-DNA from *Agrobacterium* sp. are well known in the art and include those described in Lacroix et al. (2008), Tzfira and Citovsky (2006) and Glevin (2003).

Whilst traditionally only *Agrobacterium* sp. have been used to transfer genes to plants cells, there are now a large number of systems which have been identified/developed which act in a similar manner to *Agrobacterium* sp. Several non-*Agrobacterium* species have recently been genetically modified to be competent for gene transfer (Chung et al., 2006; Broothaerts et al., 2005). These include *Rhizobium* sp. NGR234, *Sinorhizobium meliloti* and *Mezorhizobium loti*. The bacteria are made competent for gene transfer by providing the bacteria with the machinery needed for the transformation process, that is, a set of virulence genes encoded by an *Agrobacterium* Ti-plasmid and the T-DNA segment residing on a separate, small binary plasmid. Bacteria engineered in this way are capable of transforming different plant tissues (leaf disks, calli and oval tissue), monocots or dicots, and various different plant species (e.g., tobacco, rice).

Direct transfer of eukaryotic expression plasmids from bacteria to eukaryotic hosts was first achieved several decades ago by the fusion of mammalian cells and protoplasts of plasmid-carrying *Escherichia coli* (Schaffner, 1980). Since then, the number of bacteria capable of delivering genes into mammalian cells has steadily increased (Weiss, 2003), being discovered by four groups independently (Sizemore et al. 1995; Courvalin et al., 1995; Powell et al., 1996; Darji et al., 1997).

Attenuated *Shigella flexneri, Salmonella typhimurium* or *E. coli* that had been rendered invasive by the virulence plasmid (pWR100) of *S. flexneri* have been shown to be able to transfer expression plasmids after invasion of host cells and intracellular death due to metabolic attenuation. Mucosal application, either nasally or orally, of such recombinant *Shigella* or *Salmonella* induced immune responses against the antigen that was encoded by the expression plasmids. In the meantime, the list of bacteria that was shown to be able to transfer expression plasmids to mammalian host cells in vitro and in vivo has been more then doubled and has been documented for *S. typhi, S. choleraesuis, Listeria monocytogenes, Yersinia pseudotuberculosis*, and *Y. enterocolitica* (Fennelly et al., 1999; Shiau et al., 2001; Dietrich et al., 1998; Hense et al., 2001; Al-Mariri et al., 2002).

In general, it could be assumed that all bacteria that are able to enter the cytosol of the host cell (like *S. flexneri* or *L. monocytogenes*) and lyse within this cellular compartment, should be able to transfer DNA. This is known as 'abortive' or 'suicidal' invasion as the bacteria have to lyse for the DNA transfer to occur (Grillot-Courvalin et al., 1999). In addition, even many of the bacteria that remain in the phagocytic vacuole (like *S. typhimurium*) may also be able to do so. Thus, recombinant laboratory strains of *E. coli* that have been engineered to be invasive but are unable of phagosomal escape, could deliver their plasmid load to the nucleus of the infected mammalian cell nevertheless (Grillot-Courvalin et al., 1998). Furthermore, *Agrobacterium tumefaciens* has recently also been shown to introduce transgenes into mammalian cells (Kunik et al., 2001).

As used herein, the terms "transfection", "transformation" and variations thereof are generally used interchangeably. "Transfected" or "transformed" cells may have been manipulated to introduce the polynucleotide(s) of interest, or may be progeny cells derived therefrom.

Recombinant Cells

The invention also provides a recombinant cell, for example, a recombinant plant cell, which is a host cell transformed with one or more polynucleotides or vectors defined herein, or combination thereof. The term "recombinant cell" is used interchangeably with the term "transgenic cell" herein. Suitable cells of the invention include any cell that can be transformed with a polynucleotide or recombinant vector of the invention, encoding for example, a polypeptide or enzyme described herein. The cell is preferably a cell which is thereby capable of being used for producing lipid. The recombinant cell may be a cell in culture, a cell in vitro, or in an organism such as for example, a plant, or in an organ such as, for example, a seed or a leaf. Preferably, the cell is in a plant, more preferably in the seed of a plant. In one embodiment, the recombinant cell is a non-human cell.

Host cells into which the polynucleotide(s) are introduced can be either untransformed cells or cells that are already transformed with at least one nucleic acid. Such nucleic acids may be related to lipid synthesis, or unrelated. Host cells of the present invention either can be endogenously (i.e., naturally) capable of producing polypeptide(s) defined herein, in which case the recombinant cell derived therefrom has an enhanced capability of producing the polypeptide(s), or can be capable of producing said polypeptide(s) only after being transformed with at least one polynucleotide of the invention. In an embodiment, a recombinant cell of the invention has an enhanced capacity to produce non-polar lipid.

Host cells of the present invention can be any cell capable of producing at least one protein described herein, and include bacterial, fungal (including yeast), parasite, arthropod, animal, algal, and plant cells. The cells may be prokaryotic or eukaryotic. Preferred host cells are yeast, algal and plant cells. In a preferred embodiment, the plant cell is a seed cell, in particular, a cell in a cotyledon or endosperm of a seed. In one embodiment, the cell is an animal cell. The animal cell may be of any type of animal such as, for example, a non-human animal cell, a non-human vertebrate cell, a non-human mammalian cell, or cells of aquatic animals such as fish or crustacea, invertebrates, insects, etc. Non limiting examples of arthropod cells include insect cells such as *Spodoptera frugiperda* (Sf) cells, for example, Sf9, Sf21, *Trichoplusia ni* cells, and *Drosophila* S2 cells. An example of a bacterial cell useful as a host cell of the present invention is *Synechococcus* spp. (also known as *Synechocystis* spp.), for example *Synechococcus elongatus*. Examples of algal cells useful as host cells of the present invention include, for example, *Chlamydomonas* sp. (for example, *Chlamydomo-* nas reinhardtii), *Dunaliella* sp., *Haematococcus* sp., *Chlorella* sp., *Thraustochytrium* sp., *Schizochytrium* sp., and *Volvox* sp.

Host cells for expression of the instant nucleic acids may include microbial hosts that grow on a variety of feedstocks, including simple or complex carbohydrates, organic acids and alcohols and/or hydrocarbons over a wide range of temperature and pH values. Preferred microbial hosts are oleaginous organisms that are naturally capable of non-polar lipid synthesis.

The host cells may be of an organism suitable for a fermentation process, such as, for example, *Yarrowia lipolytica* or other yeasts.

Transgenic Plants

The invention also provides a plant comprising an exogenous polynucleotide or polypeptide of the invention, a cell of the invention, a vector of the invention, or a combination thereof. The term "plant" refers to whole plants, whilst the term "part thereof" refers to plant organs (e.g., leaves, stems, roots, flowers, fruit), single cells (e.g., pollen), seed, seed parts such as an embryo, endosperm, scutellum or seed coat, plant tissue such as vascular tissue, plant cells and progeny of the same. As used herein, plant parts comprise plant cells.

As used herein, the term "plant" is used in it broadest sense. It includes, but is not limited to, any species of grass, ornamental or decorative plant, crop or cereal (e.g., oilseed, maize, soybean), fodder or forage, fruit or vegetable plant, herb plant, woody plant, flower plant, or tree. It is not meant to limit a plant to any particular structure. It also refers to a unicellular plant (e.g., microalga). The term "part thereof" in reference to a plant refers to a plant cell and progeny of same, a plurality of plant cells that are largely differentiated into a colony (e.g., volvox), a structure that is present at any stage of a plant's development, or a plant tissue. Such structures include, but are not limited to, leaves, stems, flowers, fruits, nuts, roots, seed, seed coat, embryos. The term "plant tissue" includes differentiated and undifferentiated tissues of plants including those present in leaves, stems, flowers, fruits, nuts, roots, seed, for example, embryonic tissue, endosperm, dermal tissue (e.g., epidermis, periderm), vascular tissue (e.g., xylem, phloem), or ground tissue (comprising parenchyma, collenchyma, and/or sclerenchyma cells), as well as cells in culture (e.g., single cells, protoplasts, callus, embryos, etc.). Plant tissue may be in planta, in organ culture, tissue culture, or cell culture.

A "transgenic plant", "genetically modified plant" or variations thereof refers to a plant that contains a transgene not found in a wild-type plant of the same species, variety or cultivar. Transgenic plants as defined in the context of the present invention include plants and their progeny which have been genetically modified using recombinant techniques to cause production of at least one polypeptide defined herein in the desired plant or part thereof. Transgenic plant parts has a corresponding meaning.

The terms "seed" and "grain" are used interchangeably herein. "Grain" refers to mature grain such as harvested grain or grain which is still on a plant but ready for harvesting, but can also refer to grain after imbibition or germination, according to the context. Mature grain commonly has a moisture content of less than about 18-20%. In a preferred embodiment, the moisture content of the grain is at a level which is generally regarded as safe for storage, preferably between 5% and 15%, between 6% and 8%, between 8% and 10%, or between 12% and 15%. "Developing seed" as used herein refers to a seed prior to maturity, typically found in the reproductive structures of the plant after fertilisation or anthesis, but can also refer to such seeds prior to maturity which are isolated from a plant. Mature seed commonly has a moisture content of less than about 18-20%. In a preferred embodiment, the moisture content of the seed is at a level which is generally regarded as safe for storage, preferably between 5% and 15%, between 6% and 8%, between 8% and 10%, or between 12% and 15%.

As used herein, the term "plant storage organ" refers to a part of a plant specialized to store energy in the form of for example, proteins, carbohydrates, lipid. Examples of plant storage organs are seed, fruit, tuberous roots, and tubers. A preferred plant storage organ of the invention is seed.

As used herein, the term "phenotypically normal" refers to a genetically modified plant or part thereof, particularly a storage organ such as a seed, tuber or fruit of the invention not having a significantly reduced ability to grow and reproduce when compared to an unmodified plant or plant thereof. In an embodiment, the genetically modified plant or part thereof which is phenotypically normal comprises a recombinant polynucleotide encoding a silencing suppressor operably linked to a plant storage organ specific promoter and has an ability to grow or reproduce which is essentially the same as a corresponding plant or part thereof not comprising said polynucleotide. Preferably, the biomass, growth rate, germination rate, storage organ size, seed size and/or the number of viable seeds produced is not less than 90% of that of a plant lacking said recombinant polynucleotide when grown under identical conditions. This term does not encompass features of the plant which may be different to the wild-type plant but which do not effect the usefulness of the plant for commercial purposes such as, for example, a ballerina phenotype of seedling leaves.

Plants provided by or contemplated for use in the practice of the present invention include both monocotyledons and dicotyledons. In preferred embodiments, the plants of the present invention are crop plants (for example, cereals and pulses, maize, wheat, potatoes, tapioca, rice, sorghum, millet, cassava, barley, or pea), or other legumes. The plants may be grown for production of edible roots, tubers, leaves, stems, flowers or fruit. The plants may be vegetable or ornamental plants. The plants of the invention may be: *Acrocomia aculeata* (macauba palm), *Arabidopsis thaliana*, *Aracinis hypogaea* (peanut), *Astrocaryum murumuru*(murumuru), *Astrocaryum vulgare*(tucumã), *Attalea geraensis* (Indaiá-rateiro), *Attalea humilis* (American oil palm), *Attalea oleifera* (andaiá), *Attalea phalerata* (uricuri), *Attalea speciosa* (babassu), *Avena sativa* (oats), *Beta vulgaris* (sugar beet), *Brassica* sp. such as *Brassica carinata*, *Brassica juncea*, *Brassica napobrassica*, *Brassica napus* (canola), *Camelina sativa* (false flax), *Cannabis sativa* (hemp), *Carthamus tinctorius* (safflower), *Caryocar brasiliense* (pequi), *Cocos nucifera* (Coconut), *Crambe abyssinica* (Abyssinian kale), *Cucumis melo* (melon), *Elaeis guineensis* (African palm), *Glycine max* (soybean), *Gossypium hirsutum* (cotton), *Helianthus* sp. such as *Helianthus annuus* (sunflower), *Hordeum vulgare* (barley), *Jatropha curcas* (physic nut), *Joannesia princeps* (arara nut-tree), *Lemna* sp. (duckweed) such as *Lemna aequinoctialis*, *Lemna disperma*, *Lemna ecuadoriensis*, *Lemna gibba* (swollen duckweed), *Lemna japonica*, *Lemna minor*, *Lemna minuta*, *Lemna obscura*, *Lemna paucicostata*, *Lemna perpusilla*, *Lemna tenera*, *Lemna trisulca*, *Lemna turionifera*, *Lemna valdiviana*, *Lemna yungensis*, *Licania rigida* (oiticica), *Linum usitatissimum* (flax), *Lupinus angustifolius* (lupin), *Mauritia flexuosa* (buriti palm), *Maximiliana maripa* (inaja palm), *Miscanthus* sp. such as *Miscanthus×giganteus* and *Miscanthus sinensis*, *Nicotiana* sp. (tabacco) such as *Nicotiana tabacum* or *Nicotiana benthamiana*, *Oenocarpus bacaba* (bacaba-do-azeite), *Oenocarpus bataua* (patanã),

*Oenocarpus distichus* (bacaba-de-leque), *Oryza* sp. (rice) such as *Oryza sativa* and *Oryza glaberrima*, *Panicum virgatum* (switchgrass), *Paraqueiba paraensis* (mari), *Persea amencana* (avocado), *Pongamia pinnata* (Indian beech), *Populus trichocarpa*, *Ricinus communis* (castor), *Saccharum* sp. (sugarcane), *Sesamum indicum* (sesame), *Solanum tuberosum* (potato), *Sorghum* sp. such as *Sorghum bicolor, Sorghum vulgare, Theobroma grandiforum* (cupuassu), *Trifolium* sp., *Trithrinax brasiliensis* (Brazilian needle palm), *Triticum* sp. (wheat) such as *Triticum aestivum*, *Zea mays* (corn), alfalfa (*Medicago sativa*), rye (*Secale cerale*), sweet potato (*Lopmoea batatus*), cassava (*Manihot esculenta*), coffee (*Cofea* spp.), pineapple (*Anana comosus*), citris tree (*Citrus* spp.), cocoa (*Theobroma cacao*), tea (*Camellia senensis*), banana (*Musa* spp.), avocado (*Persea americana*), fig (*Ficus casica*), guava (*Psidium guajava*), mango (*Mangifer indica*), olive (*Olea europaea*), papaya (*Carica papaya*), cashew (*Anacardium occidentale*), macadamia (*Macadamia intergrifolia*) and almond (*Prunus amygdalus*).

Other preferred plants include C4 grasses such as, in addition to those mentioned above, *Andropogon gerardi, Boutelova curtipendula, B. gracilis, Buchloe dactyloides, Schizachyrium scoparium, Sorghastrum nutans, Sporobolus cryptandrus*; C3 grasses such as *Elymus canadensis*, the legumes *Lespedeza capitata* and *Petalostemum villosum*, the forb *Aster azureus*; and woody plants such as *Quercus ellipsoidalis* and *Q. macrocarpa*. Other preferred plants include C3 grasses.

In a preferred embodiment, the plant is an angiosperm.

In an embodiment, the plant is an oilseed plant, preferably an oilseed crop plant. As used herein, an "oilseed plant" is a plant species used for the commercial production of lipid from the seeds of the plant. The oilseed plant may be, for example, oil-seed rape (such as canola), maize, sunflower, safflower, soybean, sorghum, flax (linseed) or sugar beet. Furthermore, the oilseed plant may be other *Brassicas*, cotton, peanut, poppy, rutabaga, mustard, castor bean, sesame, safflower, or nut producing plants. The plant may produce high levels of lipid in its fruit such as olive, oil palm or coconut. Horticultural plants to which the present invention may be applied are lettuce, endive, or vegetable *Brassicas* including cabbage, broccoli, or cauliflower. The present invention may be applied in tobacco, cucurbits, carrot, strawberry, tomato, or pepper.

In a preferred embodiment, the transgenic plant is homozygous for each and every gene that has been introduced (transgene) so that its progeny do not segregate for the desired phenotype. The transgenic plant may also be heterozygous for the introduced transgene(s), preferably uniformly heterozygous for the transgene such as for example, in F1 progeny which have been grown from hybrid seed. Such plants may provide advantages such as hybrid vigour, well known in the art.

Where relevant, the transgenic plants may also comprise additional transgenes encoding enzymes involved in the production of non-polar lipid such as, but not limited to LPAAT, LPCAT, PAP, or a phospholipid:diacylglycerol acyltransferase (PDAT1, PDAT2 or PDAT3; see for example, Ghosal et al., 2007), or a combination of two or more thereof. The transgenic plants of the invention may also express oleosin from an exogenous polynucleotide.

Transformation of Plants

Transgenic plants can be produced using techniques known in the art, such as those generally described in Slater et al., Plant Biotechnology—The Genetic Manipulation of Plants, Oxford University Press (2003), and Christou and Klee, Handbook of Plant Biotechnology, John Wiley and Sons (2004).

As used herein, the terms "stably transforming", "stably transformed" and variations thereof refer to the integration of the polynucleotide into the genome of the cell such that they are transferred to progeny cells during cell division without the need for positively selecting for their presence. Stable transformants, or progeny thereof, can be selected by any means known in the art such as Southern blots on chromosomal DNA, or in situ hybridization of genomic DNA.

*Agrobacterium*-mediated transfer is a widely applicable system for introducing genes into plant cells because DNA can be introduced into cells in whole plant tissues, plant organs, or explants in tissue culture, for either transient expression, or for stable integration of the DNA in the plant cell genome. The use of *Agrobacterium*-mediated plant integrating vectors to introduce DNA into plant cells is well known in the art (see for example, U.S. Pat. No. 5,177,010, U.S. Pat. No. 5,104,310, U.S. Pat. No. 5,004,863, or U.S. Pat. No. 5,159,135). The region of DNA to be transferred is defined by the border sequences, and the intervening DNA (T-DNA) is usually inserted into the plant genome. Further, the integration of the T-DNA is a relatively precise process resulting in few rearrangements. In those plant varieties where *Agrobacterium*-mediated transformation is efficient, it is the method of choice because of the facile and defined nature of the gene transfer. Preferred *Agrobacterium* transformation vectors are capable of replication in *E. coli* as well as *Agrobacterium*, allowing for convenient manipulations as described (Klee et al., In: Plant DNA Infectious Agents, Hohn and Schell, eds., Springer-Verlag, New York, pp. 179-203 (1985)).

Acceleration methods that may be used include for example, microprojectile bombardment and the like. One example of a method for delivering transforming nucleic acid molecules to plant cells is microprojectile bombardment. This method has been reviewed by Yang et al., Particle Bombardment Technology for Gene Transfer, Oxford Press, Oxford, England (1994). Non-biological particles (microprojectiles) that may be coated with nucleic acids and delivered into cells by a propelling force. Exemplary particles include those comprised of tungsten, gold, platinum, and the like. A particular advantage of microprojectile bombardment, in addition to it being an effective means of reproducibly transforming monocots, is that neither the isolation of protoplasts, nor the susceptibility of *Agrobacterium* infection are required. An illustrative embodiment of a method for delivering DNA into *Zea mays* cells by acceleration is a biolistics α-particle delivery system, that can be used to propel particles coated with DNA through a screen such as a stainless steel or Nytex screen, onto a filter surface covered with corn cells cultured in suspension. A particle delivery system suitable for use with the present invention is the helium acceleration PDS-1000/He gun available from Bio-Rad Laboratories.

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein, one may obtain up to 1000 or more foci of cells transiently expressing a marker gene. The number of cells in a focus that express the gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment, and also the nature of the transforming DNA such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include particle gun delivery of DNA containing a selectable marker and targeting of the DNA to the plastid genome through homologous recombination (U.S. Pat. No. 5,451,513, U.S. Pat. No. 5,545,818, U.S. Pat. No. 5,877,402, U.S. Pat. No. 5,932,479, and WO 99/05265).

Accordingly, it is contemplated that one may wish to adjust various aspects of the bombardment parameters in small scale studies to fully optimize the conditions. One may particularly wish to adjust physical parameters such as gap distance, flight distance, tissue distance, and helium pressure. One may also minimize the trauma reduction factors by modifying conditions that influence the physiological state of the recipient cells and that may therefore influence transformation and integration efficiencies. For example, the osmotic state, tissue hydration and the subculture stage, or cell cycle of the recipient cells, may be adjusted for optimum transformation. The execution of other routine adjustments will be known to those of skill in the art in light of the present disclosure.

Transformation of plant protoplasts can be achieved using methods based on calcium phosphate precipitation, polyethylene glycol treatment, electroporation, and combinations of these treatments. Application of these systems to different plant varieties depends upon the ability to regenerate that particular plant strain from protoplasts. Illustrative methods for the regeneration of cereals from protoplasts are described (Fujimura et al., 1985; Toriyama et al., 1986; Abdullah et al., 1986).

Other methods of cell transformation can also be used and include but are not limited to the introduction of DNA into plants by direct DNA transfer into pollen, by direct injection of DNA into reproductive organs of a plant, or by direct injection of DNA into the cells of immature embryos followed by the rehydration of desiccated embryos.

The regeneration, development, and cultivation of plants from single plant protoplast transformants or from various transformed explants is well known in the art (Weissbach et al., In: Methods for Plant Molecular Biology, Academic Press, San Diego, Calif., (1988)). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polynucleotide is cultivated using methods well known to one skilled in the art.

Methods for transforming dicots, primarily by use of *Agrobacterium tumefaciens*, and obtaining transgenic plants have been published for cotton (U.S. Pat. No. 5,004,863, U.S. Pat. No. 5,159,135, U.S. Pat. No. 5,518,908), soybean (U.S. Pat. No. 5,569,834, U.S. Pat. No. 5,416,011), *Brassica* (U.S. Pat. No. 5,463,174), peanut (Cheng et al., 1996), and pea (Grant et al., 1995).

Methods for transformation of cereal plants such as wheat and barley for introducing genetic variation into the plant by introduction of an exogenous nucleic acid and for regeneration of plants from protoplasts or immature plant embryos are well known in the art, see for example, CA 2,092,588, AU 61781/94, AU 667939, U.S. Pat. No. 6,100,447, WO 97/048814, U.S. Pat. No. 5,589,617, U.S. Pat. No. 6,541,257, and other methods are set out in WO 99/14314. Preferably, transgenic wheat or barley plants are produced by *Agrobacterium tumefaciens* mediated transformation procedures. Vectors carrying the desired polynucleotide may be introduced into regenerable wheat cells of tissue cultured plants or explants, or suitable plant systems such as protoplasts.

The regenerable wheat cells are preferably from the scutellum of immature embryos, mature embryos, callus derived from these, or the meristematic tissue.

To confirm the presence of the transgenes in transgenic cells and plants, a polymerase chain reaction (PCR) amplification or Southern blot analysis can be performed using methods known to those skilled in the art. Expression products of the transgenes can be detected in any of a variety of ways, depending upon the nature of the product, and include Western blot and enzyme assay. One particularly useful way to quantitate protein expression and to detect replication in different plant tissues is to use a reporter gene such as GUS. Once transgenic plants have been obtained, they may be grown to produce plant tissues or parts having the desired phenotype. The plant tissue or plant parts, may be harvested, and/or the seed collected. The seed may serve as a source for growing additional plants with tissues or parts having the desired characteristics. Preferably, the vegetative plant parts are harvested at a time when the yield of non-polar lipids are at their highest. In one embodiment, the vegetative plant parts are harvested about at the time of flowering.

A transgenic plant formed using *Agrobacterium* or other transformation methods typically contains a single genetic locus on one chromosome. Such transgenic plants can be referred to as being hemizygous for the added gene(s). More preferred is a transgenic plant that is homozygous for the added gene(s), that is, a transgenic plant that contains two added genes, one gene at the same locus on each chromosome of a chromosome pair. A homozygous transgenic plant can be obtained by self-fertilising a hemizygous transgenic plant, germinating some of the seed produced and analyzing the resulting plants for the gene of interest.

It is also to be understood that two different transgenic plants that contain two independently segregating exogenous genes or loci can also be crossed (mated) to produce offspring that contain both sets of genes or loci. Selfing of appropriate F1 progeny can produce plants that are homozygous for both exogenous genes or loci. Back-crossing to a parental plant and out-crossing with a non-transgenic plant are also contemplated, as is vegetative propagation. Descriptions of other breeding methods that are commonly used for different traits and crops can be found in Fehr, In: Breeding Methods for Cultivar Development, Wilcox J. ed., American Society of Agronomy, Madison Wis. (1987).

Tilling

In one embodiment, TILLING (Targeting Induced Local Lesions IN Genomes) can be used to produce plants in which endogenous genes are knocked out, for example genes encoding a DGAT, sn-1 glycerol-3-phosphate acyltransferase (GPAT), 1-acyl-glycerol-3-phosphate acyltransferase (LPAAT), acyl-CoA:lysophosphatidylcholine acyltransferase (LPCAT), phosphatidic acid phosphatase (PAP), or a combination of two or more thereof.

In a first step, introduced mutations such as novel single base pair changes are induced in a population of plants by treating seeds (or pollen) with a chemical mutagen, and then advancing plants to a generation where mutations will be stably inherited. DNA is extracted, and seeds are stored from all members of the population to create a resource that can be accessed repeatedly over time.

For a TILLING assay, PCR primers are designed to specifically amplify a single gene target of interest. Specificity is especially important if a target is a member of a gene family or part of a polyploid genome. Next, dye-labeled primers can be used to amplify PCR products from pooled DNA of multiple individuals. These PCR products are denatured and reannealed to allow the formation of mismatched base pairs. Mismatches, or heteroduplexes, represent both naturally occurring single nucleotide polymorphisms (SNPs) (i.e., several plants from the population are likely to carry the same polymorphism) and induced SNPs (i.e., only rare individual plants are likely to display the mutation). After heteroduplex formation, the use of an endonuclease, such as Cel1, that recognizes and cleaves mismatched DNA is the key to discovering novel SNPs within a TILLING population.

Using this approach, many thousands of plants can be screened to identify any individual with a single base change as well as small insertions or deletions (1-30 bp) in any gene or specific region of the genome. Genomic fragments being assayed can range in size anywhere from 0.3 to 1.6 kb. At 8-fold pooling, 1.4 kb fragments (discounting the ends of fragments where SNP detection is problematic due to noise) and 96 lanes per assay, this combination allows up to a million base pairs of genomic DNA to be screened per single assay, making TILLING a high-throughput technique. TILLING is further described in Slade and Knauf (2005), and Henikoff et al. (2004).

In addition to allowing efficient detection of mutations, high-throughput TILLING technology is ideal for the detection of natural polymorphisms. Therefore, interrogating an unknown homologous DNA by heteroduplexing to a known sequence reveals the number and position of polymorphic sites. Both nucleotide changes and small insertions and deletions are identified, including at least some repeat number polymorphisms. This has been called Ecotilling (Comai et al., 2004).

Each SNP is recorded by its approximate position within a few nucleotides. Thus, each haplotype can be archived based on its mobility. Sequence data can be obtained with a relatively small incremental effort using aliquots of the same amplified DNA that is used for the mismatch-cleavage assay. The left or right sequencing primer for a single reaction is chosen by its proximity to the polymorphism. Sequencher software performs a multiple alignment and discovers the base change, which in each case confirmed the gel band.

Ecotilling can be performed more cheaply than full sequencing, the method currently used for most SNP discovery. Plates containing arrayed ecotypic DNA can be screened rather than pools of DNA from mutagenized plants. Because detection is on gels with nearly base pair resolution and background patterns are uniform across lanes, bands that are of identical size can be matched, thus discovering and genotyping SNPs in a single step. In this way, ultimate sequencing of the SNP is simple and efficient, made more so by the fact that the aliquots of the same PCR products used for screening can be subjected to DNA sequencing.

Enhancing Exogenous RNA Levels and Stabilized Expression

Post-transcriptional gene silencing (PTGS) is a nucleotide sequence-specific defense mechanism that can target both cellular and viral mRNAs for degradation. PTGS occurs in plants or fungi stably or transiently transformed with a recombinant polynucleotide(s) and results in the reduced accumulation of RNA molecules with sequence similarity to the introduced polynucleotide. "Post-transcriptional" refers to a mechanism operating at least partly, but not necessarily exclusively, after production of an initial RNA transcript, for example during processing of the initial RNA transcript, or concomitant with splicing or export of the RNA to the cytoplasm, or within the cytoplasm by complexes associated with Argonaute proteins.

RNA molecule levels can be increased, and/or RNA molecule levels stabilized over numerous generations or under different environmental conditions, by limiting the expression of a silencing suppressor in a storage organ of a plant or part thereof. As used herein, a "silencing suppressor" is any polynucleotide or polypeptide that can be expressed in a plant cell that enhances the level of expression product from a different transgene in the plant cell, particularly, over repeated generations from the initially transformed plant. In an embodiment, the silencing suppressor is a viral silencing suppressor or mutant thereof. A large number of viral silencing suppressors are known in the art and include, but are not limited to P19, V2, P38, Pe-Po and RPV-P0. Examples of suitable viral silencing suppressors include those described in WO 2010/057246. A silencing suppressor may be stably expressed in a plant or part thereof of the present invention.

As used herein, the term "stably expressed" or variations thereof refers to the level of the RNA molecule being essentially the same or higher in progeny plants over repeated generations, for example, at least three, at least five, or at least ten generations, when compared to corresponding plants lacking the exogenous polynucleotide encoding the silencing suppressor. However, this term(s) does not exclude the possibility that over repeated generations there is some loss of levels of the RNA molecule when compared to a previous generation, for example, not less than a 10% loss per generation.

The suppressor can be selected from any source e.g. plant, viral, mammal, etc. The suppressor may be, for example, flock house virus B2, pothos latent virus P14, pothos latent virus AC2, African cassava mosaic virus AC4, bhendi yellow vein mosaic disease C2, bhendi yellow vein mosaic disease C4, bhendi yellow vein mosaic disease βC1, tomato chlorosis virus p22, tomato chlorosis virus CP, tomato chlorosis virus CPm, tomato golden mosaic virus AL2, tomato leaf curl Java virus βC1, tomato yellow leaf curl virus V2, tomato yellow leaf curl virus-China C2, tomato yellow leaf curl China virus Y10 isolate βC1, tomato yellow leaf curl Israeli isolate V2, mungbean yellow mosaic virus-Vigna AC2, hibiscus chlorotic ringspot virus CP, turnip crinkle virus P38, turnip crinkle virus CP, cauliflower mosaic virus P6, beet yellows virus p21, citrus tristeza virus p20, citrus tristeza virus p23, citrus tristeza virus CP, cowpea mosaic virus SCP, sweet potato chlorotic stunt virus p22, cucumber mosaic virus 2b, tomato aspermy virus HC-Pro, beet curly top virus L2, soil borne wheat mosaic virus 19K, barley stripe mosaic virus Gammab, poa semilatent virus Gammab, peanut clump pecluvirus P15, rice dwarf virus Pns10, curubit aphid borne yellows virus P0, beet western yellows virus P0, potato virus X P25, cucumber vein yellowing virus P1b, plum pox virus HC-Pro, sugarcane mosaic virus HC-Pro, potato virus Y strain HC-Pro, tobacco etch virus P1/HC-Pro, turnip mosaic virus P1/HC-Pro, cocksfoot mottle virus P1, cocksfoot mottle virus-Norwegian isolate P1, rice yellow mottle virus P1, rice yellow mottle virus-Nigerian isolate P1, rice hoja blanca virus NS3, rice stripe virus NS3, crucifer infecting tobacco mosaic virus 126K, crucifer infecting tobacco mosaic virus p122, tobacco mosaic virus p122, tobacco mosaic virus 126, tobacco mosaic virus 130K, tobacco rattle virus 16K, tomato bushy stunt virus P19, tomato spotted wilt virus NSs, apple chlorotic leaf spot virus P50, grapevine virus A p10, grapevine leafroll associated virus-2 homolog of BYV p21, as well as variants/mutants thereof. The list above provides the virus from which the suppressor can be obtained and the protein (e.g., B2, P14, etc.), or coding region designation for the suppressor from each particular virus. Other candidate silencing suppressors may be obtained by examining viral genome sequences for polypeptides encoded at the same position within the viral genome, relative to the structure of a related viral genome comprising a known silencing suppressor, as is appreciated by a person of skill in the art.

Silencing suppressors can be categorized based on their mode of action. Suppressors such as V2 which preferentially bind to a double-stranded RNA molecule which has overhanging 5' ends relative to a corresponding double-stranded RNA molecule having blunt ends are particularly useful for enhancing transgene expression when used in combination with gene silencing (exogenous polynucleotide encoding a dsRNA). Other suppressors such as p19 which preferentially bind a dsRNA molecule which is 21 base pairs in length relative to a dsRNA molecule of a different length can also allow transgene expression in the presence of an exogenous polynucleotide encoding a dsRNA, but generally to a lesser degree than, for example, V2. This allows the selection of an optimal combination of dsRNA, silencing suppressor and over-expressed transgene for a particular purpose. Such optimal combinations can be identified using a method of the invention.

In an embodiment, the silencing suppressor preferentially binds to a double-stranded RNA molecule which has overhanging 5' ends relative to a corresponding double-stranded RNA molecule having blunt ends. In this context, the corresponding double-stranded RNA molecule preferably has the same nucleotide sequence as the molecule with the 5' overhanging ends, but without the overhanging 5' ends. Binding assays are routinely performed, for example in in vitro assays, by any method as known to a person of skill in the art.

Multiple copies of a suppressor may be used. Different suppressors may be used together (e.g., in tandem).

Essentially any RNA molecule which is desirable to be expressed in a plant storage organ can be co-expressed with the silencing suppressor. The RNA molecule may influence an agronomic trait, insect resistance, disease resistance, herbicide resistance, sterility, grain characteristics, and the like. The encoded polypeptides may be involved in metabolism of lipid, starch, carbohydrates, nutrients, etc., or may be responsible for the synthesis of proteins, peptides, lipids, waxes, starches, sugars, carbohydrates, flavors, odors, toxins, carotenoids. hormones, polymers, flavonoids, storage proteins, phenolic acids, alkaloids, lignins, tannins, celluloses, glycoproteins, glycolipids, etc.

In a particular example, the plants produced increased levels of enzymes for lipid production in plants such as *Brassicas*, for example oilseed rape or sunflower, safflower, flax, cotton, soya bean or maize.

Plant Biomass

An increase in the total lipid content of plant biomass equates to greater energy content, making its use in the production of biofuel more economical.

Plant biomass is the organic materials produced by plants, such as leaves, roots, seeds, and stalks. Plant biomass is a complex mixture of organic materials, such as carbohydrates, fats, and proteins, along with small amounts of minerals, such as sodium, phosphorus, calcium, and iron. The main components of plant biomass are carbohydrates (approximately 75%, dry weight) and lignin (approximately 25%), which can vary with plant type. The carbohydrates are mainly cellulose or hemicellulose fibers, which impart strength to the plant structure, and lignin, which holds the fibers together. Some plants also store starch (another carbohydrate polymer) and fats as sources of energy, mainly in seeds and roots (such as corn, soybeans, and potatoes).

Plant biomass typically has a low energy density as a result of both its physical form and moisture content. This makes it inconvenient and inefficient for storage and transport, and also usually unsuitable for use without some kind of pre-processing.

There are a range of processes available to convert it into a more convenient form including: 1) physical pre-processing (for example, grinding) or 2) conversion by thermal (for example, combustion, gasification, pyrolysis) or chemical (for example, anaerobic digestion, fermentation, composting, transesterification) processes. In this way, the biomass is converted into what can be described as a biomass fuel.

Combustion

Combustion is the process by which flammable materials are allowed to burn in the presence of air or oxygen with the release of heat. The basic process is oxidation. Combustion is the simplest method by which biomass can be used for energy, and has been used to provide heat. This heat can itself be used in a number of ways: 1) space heating, 2) water (or other fluid) heating for central or district heating or process heat, 3) steam raising for electricity generation or motive force. When the flammable fuel material is a form of biomass the oxidation is of predominantly the carbon (C) and hydrogen (H) in the cellulose, hemicellulose, lignin, and other molecules present to form carbon dioxide ($CO_2$) and water ($H_2O$).

Gasification

Gasification is a partial oxidation process whereby a carbon source such as plant biomass, is broken down into carbon monoxide (CO) and hydrogen ($H_2$), plus carbon dioxide ($CO_2$) and possibly hydrocarbon molecules such as methane ($CH_4$). If the gasification takes place at a relatively low temperature, such as 700° C. to 1000° C., the product gas will have a relatively high level of hydrocarbons compared to high temperature gasification. As a result it may be used directly, to be burned for heat or electricity generation via a steam turbine or, with suitable gas clean up, to run an internal combustion engine for electricity generation. The combustion chamber for a simple boiler may be close coupled with the gasifier, or the producer gas may be cleaned of longer chain hydrocarbons (tars), transported, stored and burned remotely. A gasification system may be closely integrated with a combined cycle gas turbine for electricity generation (IGCC—integrated gasification combined cycle). Higher temperature gasification (1200° C. to 1600° C.) leads to few hydrocarbons in the product gas, and a higher proportion of CO and $H_2$. This is known as synthesis gas (syngas or biosyngas) as it can be used to synthesize longer chain hydrocarbons using techniques such as Fischer-Tropsch (FT) synthesis. If the ratio of $H_2$ to CO is correct (2:1) FT synthesis can be used to convert syngas into high quality synthetic diesel biofuel which is compatible with conventional fossil diesel and diesel engines.

Pyrolysis

As used herein, the term "pyrolysis" means a process that uses slow heating in the absence of oxygen to produce gaseous, oil and char products from biomass. Pyrolysis is a thermal or thermo-chemical conversion of lipid-based, particularly triglyceride-based, materials. The products of pyrolysis include gas, liquid and a sold char, with the proportions of each depending upon the parameters of the process. Lower temperatures (around 400° C.) tend to produce more solid char (slow pyrolysis), whereas somewhat higher temperatures (around 500° C.) produce a much higher proportion of liquid (bio-oil), provided the vapour residence time is kept down to around is or less. After this, secondary reactions take place and increase the gas yield. The bio-oil produced by fast (higher temperature) pyrolysis is a dark brown, mobile liquid with a heating value about half that of conventional fuel oil. It can be burned directly, co-fired, upgraded to other fuels or gasified.

Pyrolysis involves direct thermal cracking of the lipids or a combination of thermal and catalytic cracking. At temperatures of about 400-500° C., cracking occurs, producing short chain hydrocarbons such as alkanes, alkenes, alkadienes, aromatics, olefins and carboxylic acid, as well as carbon monoxide and carbon dioxide.

Four main catalyst types can be used including transition metal catalysts, molecular sieve type catalysts, activated alumina and sodium carbonate (Maher et al., 2007). Examples are given in U.S. Pat. No. 4,102,938. Alumina ($Al_2O_3$) activated by acid is an effective catalyst (U.S. Pat. No. 5,233,109). Molecular sieve catalysts are porous, highly crystalline structures that exhibit size selectivity, so that molecules of only certain sizes can pass through. These include zeolite catalysts such as ZSM-5 or HZSM-5 which are crystalline materials comprising $AlO_4$ and $SiO_4$ and other silica-alumina catalysts. The activity and selectivity of these catalysts depends on the acidity, pore size and pore shape, and typically operate at 300-500° C. Transition metal catalysts are described for example in U.S. Pat. No. 4,992,605. Sodium carbonate catalyst has been used in the pyrolysis of oils (Dandik and Aksoy, 1998).

Transesterification

"Transesterification" as used herein is the conversion of lipids, principally triacylglycerols, into fatty acid methyl esters or ethyl esters using short chain alcohols such as methanol or ethanol, in the presence of a catalyst such as alkali or acid. Methanol is used more commonly due to low cost and availability. The catalysts may be homogeneous catalysts, heterogeneous catalysts or enzymatic catalysts. Homogeneous catalysts include ferric sulphate followed by KOH. Heterogeneous catalysts include CaO, $K_3PO_4$, and $WO_3/ZrO_2$. Enzymatic catalysts include Novozyme 435 produced from *Candida antarctica*.

Anaerobic Digestion

Anaerobic digestion is the process whereby bacteria break down organic material in the absence of air, yielding a biogas containing methane. The products of this process are biogas (principally methane ($CH_4$) and carbon dioxide ($CO_2$)), a solid residue (fibre or digestate) that is similar, but not identical, to compost and a liquid liquor that can be used as a fertilizer. The methane can be burned for heat or electricity generation. The solid residue of the anaerobic digestion process can be used as a soil conditioner or alternatively can be burned as a fuel, or gasified.

Anaerobic digestion is typically performed on biological material in an aqueous slurry. However there are an increasing number of dry digesters. Mesophilic digestion takes place between 20° C. and 40° C. and can take a month or two to complete. Thermophilic digestion takes place from 50-65° C. and is faster, but the bacteria are more sensitive.

Fermentation

Conventional fermentation processes for the production of bioalcohol make use of the starch and sugar components of plant crops. Second generation bioalcohol precedes this with acid and/or enzymatic hydrolysis of hemicellulose and cellulose into fermentable saccharides to make use of a much larger proportion of available biomass. More detail is provided below under the heading "Fermentation processes for lipid production".

Composting

Composting is the aerobic decomposition of organic matter by microorganisms. It is typically performed on relatively dry material rather than a slurry. Instead of, or in addition to, collecting the flammable biogas emitted, the exothermic nature of the composting process can be exploited and the heat produced used, usually using a heat pump.

Production of Non-Polar Lipids

Techniques that are routinely practiced in the art can be used to extract, process, purify and analyze the non-polar lipids produced by cells, organisms or parts thereof of the instant invention. Such techniques are described and explained throughout the literature in sources such as, Fereidoon Shahidi, Current Protocols in Food Analytical Chemistry, John Wiley & Sons, Inc. (2001) D1.1.1-D1.1.11, and Perez-Vich et al. (1998).

Production of Seedoil

Typically, plant seeds are cooked, pressed, and/or extracted to produce crude seedoil, which is then degummed, refined, bleached, and deodorized. Generally, techniques for crushing seed are known in the art. For example, oilseeds can be tempered by spraying them with water to raise the moisture content to, for example, 8.5%, and flaked using a smooth roller with a gap setting of 0.23 to 0.27 mm. Depending on the type of seed, water may not be added prior to crushing. Application of heat deactivates enzymes, facilitates further cell rupturing, coalesces the lipid droplets, and agglomerates protein particles, all of which facilitate the extraction process.

In an embodiment, the majority of the seedoil is released by passage through a screw press. Cakes expelled from the screw press are then solvent extracted for example, with hexane, using a heat traced column. Alternatively, crude seedoil produced by the pressing operation can be passed through a settling tank with a slotted wire drainage top to remove the solids that are expressed with the seedoil during the pressing operation. The clarified seedoil can be passed through a plate and frame filter to remove any remaining fine solid particles. If desired, the seedoil recovered from the extraction process can be combined with the clarified seedoil to produce a blended crude seedoil.

Once the solvent is stripped from the crude seedoil, the pressed and extracted portions are combined and subjected to normal lipid processing procedures (i.e., degumming, caustic refining, bleaching, and deodorization).

In an embodiment, the oil and/or protein content of the seed is analysed by near-infrared reflectance spectroscopy as described in Hom et al. (2007).

Degumming

Degumming is an early step in the refining of oils and its primary purpose is the removal of most of the phospholipids from the oil, which may be present as approximately 1-2% of the total extracted lipid. Addition of ~2% of water, typically containing phosphoric acid, at 70-80° C. to the crude oil results in the separation of most of the phospholipids accompanied by trace metals and pigments. The insoluble material that is removed is mainly a mixture of phospholipids and triacylglycerols and is also known as lecithin. Degumming can be performed by addition of concentrated phosphoric acid to the crude seedoil to convert non-hydratable phosphatides to a hydratable form, and to chelate minor metals that are present. Gum is separated from the seedoil by centrifugation. The seedoil can be refined by addition of a sufficient amount of a sodium hydroxide solution to titrate all of the fatty acids and removing the soaps thus formed.

Alkali Refining

Alkali refining is one of the refining processes for treating crude oil, sometimes also referred to as neutralization. It usually follows degumming and precedes bleaching. Following degumming, the seedoil can treated by the addition of a sufficient amount of an alkali solution to titrate all of the fatty acids and phosphoric acids, and removing the soaps thus formed. Suitable alkaline materials include sodium hydroxide, potassium hydroxide, sodium carbonate, lithium hydroxide, calcium hydroxide, calcium carbonate and ammonium hydroxide. This process is typically carried out at room temperature and removes the free fatty acid fraction. Soap is removed by centrifugation or by extraction into a solvent for the soap, and the neutralised oil is washed with water. If required, any excess alkali in the oil may be neutralized with a suitable acid such as hydrochloric acid or sulphuric acid.

Bleaching

Bleaching is a refining process in which oils are heated at 90-120° C. for 10-30 minutes in the presence of a bleaching earth (0.2-2.0%) and in the absence of oxygen by operating with nitrogen or steam or in a vacuum. This step in oil processing is designed to remove unwanted pigments (carotenoids, chlorophyll, gossypol etc), and the process also removes oxidation products, trace metals, sulphur compounds and traces of soap.

Deodorization

Deodorization is a treatment of oils and fats at a high temperature (200-260° C.) and low pressure (0.1-1 mm Hg). This is typically achieved by introducing steam into the seedoil at a rate of about 0.1 ml/minute/100 ml of seedoil. Deodorization can be performed by heating the seedoil to 260° C. under vacuum, and slowly introducing steam into the seedoil at a rate of about 0.1 ml/minute/100 ml of seedoil. After about 30 minutes of sparging, the seedoil is allowed to cool under vacuum. The seedoil is typically transferred to a glass container and flushed with argon before being stored under refrigeration. If the amount of seedoil is limited, the seedoil can be placed under vacuum for example, in a Parr reactor and heated to 260° C. for the same length of time that it would have been deodorized. This treatment improves the colour of the seedoil and removes a majority of the volatile substances or odorous compounds including any remaining free fatty acids, monoacylglycerols and oxidation products.

Winterisation

Winterization is a process sometimes used in commercial production of oils for the separation of oils and fats into solid (stearin) and liquid (olein) fractions by crystallization at sub-ambient temperatures. It was applied originally to cottonseed oil to produce a solid-free product. It is typically used to decrease the saturated fatty acid content of oils.

Plant Biomass for the Production of Lipids

Parts of plants involved in photosynthesis (e.g., and stems and leaves of higher plants and aquatic plants such as algae) can also be used to produce lipid. Independent of the type of plant, there are several methods for extracting lipids from green biomass. One way is physical extraction, which often does not use solvent extraction. It is a "traditional" way using several different types of mechanical extraction. Expeller pressed extraction is a common type, as are the screw press and ram press extraction methods. The amount of lipid extracted using these methods varies widely, depending upon the plant material and the mechanical process employed. Mechanical extraction is typically less efficient than solvent extraction described below.

In solvent extraction, an organic solvent (e.g., hexane) is mixed with at least the genetically modified plant green biomass, preferably after the green biomass is dried and ground. Of course, other parts of the plant besides the green biomass (e.g., lipid-containing seeds) can be ground and mixed in as well. The solvent dissolves the lipid in the biomass and the like, which solution is then separated from the biomass by mechanical action (e.g., with the pressing processes above). This separation step can also be performed by filtration (e.g., with a filter press or similar device) or centrifugation etc. The organic solvent can then be separated from the non-polar lipid (e.g., by distillation). This second separation step yields non-polar lipid from the plant and can yield a re-usable solvent if one employs conventional vapor recovery.

If, for instance, vegetative tissue as described herein, is not to be used immediately to extract, and/or process, the lipid it is preferably handled post-harvest to ensure the lipid content does not decrease, or such that any decrease in lipid content is minimized as much as possible (see, for example, Christie, 1993). In one embodiment, the vegetative tissue is frozen as soon as possible after harvesting using, for example, dry ice or liquid nitrogen. In another embodiment, the vegetative tissue is stored at a cold temperature, for example –20° C. or –60° C. in an atmosphere of nitrogen.

Algae for the Production of Lipids

Algae can produce 10 to 100 times as much mass as terrestrial plants in a year. In addition to being a prolific organism, algae are also capable of producing oils and starches that can be converted into biofuels.

The specific algae most useful for biofuel production are known as microalgae, consisting of small, often unicellular, types. These algae can grow almost anywhere. With more than 100,000 known species of diatoms (a type of alga), 40,000 known species of green plant-like algae, and smaller numbers of other algae species, algae will grow rapidly in nearly any environment, with almost any kind of water. Specifically, useful algae can be grown in marginal areas with limited or poor quality water, such as in the arid and mostly empty regions of the American Southwest. These areas also have abundant sunshine for photosynthesis. In short, algae can be an ideal organism for production of biofuels—efficient growth, needing no premium land or water, not competing with food crops, needing much smaller amounts of land than food crops, and storing energy in a desirable form.

Algae can store energy in its cell structure in the form of either oil or starch. Stored oil can be as much as 60% of the weight of the algae. Certain species which are highly prolific in oil or starch production have been identified, and growing conditions have been tested. Processes for extracting and converting these materials to fuels have also been developed.

The most common oil-producing algae can generally include, or consist essentially of, the diatoms (bacillariophytes), green algae (chlorophytes), blue-green algae (cyanophytes), and golden-brown algae (chrysophytes). In addition a fifth group known as haptophytes may be used. Groups include brown algae and heterokonts. Specific non-limiting examples algae include the Classes: Chlorophyceae, Eustigmatophyceae, Prymnesiophyceae, Bacillariophyceae. Bacillariophytes capable of oil production include the genera *Amphipleura, Amphora, Chaetoceros, Cyclotella, Cymbella, Fragilaria, Hantzschia, Navicula, Nitzschia, Phaeodactylum*, and *Thalassiosira*. Specific non-limiting examples of chlorophytes capable of oil production include *Ankistrodesmus, Botryococcus, Chlorella, Chlorococcum, Dunaliella, Monoraphidium, Oocystis, Scenedesmus*, and *Tetraselmis*. In one aspect, the chlorophytes can be *Chlorella* or *Dunaliella*. Specific non-limiting examples of cyanophytes capable of oil production include *Oscillatoria* and *Synechococcus*. A specific example of chrysophytes capable of oil production includes *Boekelovia*. Specific non-limiting examples of haptophytes include *Isochysis* and *Pleurochysis*.

Specific algae useful in the present invention include, for example, *Chlamydomonas* sp. such as *Chlamydomonas reinhardtii, Dunaliella* sp. such as *Dunaliella salina, Dunaliella tertiolecta, D. acidophila, D. bardawil, D. bioculata, D. lateralis, D. maritima, D. minuta, D. parva, D. peircei, D. polymorpha, D. primolecta, D. pseudosalina, D. quartolecta. D. viridis, Haematococcus* sp., *Chlorella* sp. such as *Chlorella vulgaris, Chlorella sorokiniana* or *Chlorella protothecoides, Thraustochytrium* sp., *Schizochytrium* sp., *Volvox* sp, *Nannochloropsis* sp., *Botryococcus braunii* which can contain over 60 wt % lipid, *Phaeodactylum tricornutum, Thalassiosira pseudonana, Isochrysis* sp., *Pavlova* sp., *Chlorococcum* sp, *Ellipsoidion* sp., *Neochloris* sp., *Scenedesmus* sp.

Further, the oil-producing algae of the present invention can include a combination of an effective amount of two or more strains in order to maximize benefits from each strain. As a practical matter, it can be difficult to achieve 100% purity of a single strain of algae or a combination of desired algae strains. However, when discussed herein, the oil-producing algae is intended to cover intentionally introduced strains of algae, while foreign strains are preferably minimized and kept below an amount which would detrimentally affect yields of desired oil-producing algae and algal oil. Undesirable algae strains can be controlled and/or eliminated using any number of techniques. For example, careful control of the growth environment can reduce introduction of foreign strains. Alternatively, or in addition to other techniques, a virus selectively chosen to specifically target only the foreign strains can be introduced into the growth reservoirs in an amount which is effective to reduce and/or eliminate the foreign strain. An appropriate virus can be readily identified using conventional techniques. For example, a sample of the foreign algae will most often include small amounts of a virus which targets the foreign algae. This virus can be isolated and grown in order to produce amounts which would effectively control or eliminate the foreign algae population among the more desirable oil-producing algae.

Algaculture is a form of aquaculture involving the farming of species of algae (including microalgae, also referred to as phytoplankton, microphytes, or planktonic algae, and macroalgae, commonly known as seaweed).

Commercial and industrial algae cultivation has numerous uses, including production of food ingredients, food, and algal fuel.

Mono or mixed algal cultures can be cultured in open-ponds (such as raceway-type ponds and lakes) or photobioreactors.

Algae can be harvested using microscreens, by centrifugation, by flocculation (using for example, chitosan, alum and ferric chloride) and by froth flotation. Interrupting the carbon dioxide supply can cause algae to flocculate on its own, which is called "autoflocculation". In froth flotation, the cultivator aerates the water into a froth, and then skims the algae from the top. Ultrasound and other harvesting methods are currently under development.

Lipid may be separated from the algae by mechanical crushing. When algae is dried it retains its lipid content, which can then be "pressed" out with an oil press. Since different strains of algae vary widely in their physical attributes, various press configurations (screw, expeller, piston, etc.) work better for specific algae types.

Osmotic shock is sometimes used to release cellular components such as lipid from algae. Osmotic shock is a sudden reduction in osmotic pressure and can cause cells in a solution to rupture.

Ultrasonic extraction can accelerate extraction processes, in particular enzymatic extraction processes employed to extract lipid from algae. Ultrasonic waves are used to create cavitation bubbles in a solvent material. When these bubbles collapse near the cell walls, the resulting shock waves and liquid jets cause those cells walls to break and release their contents into a solvent.

Chemical solvents (for example, hexane, benzene, petroleum ether) are often used in the extraction of lipids from algae. Soxhlet extraction can be use to extract lipids from algae through repeated washing, or percolation, with an organic solvent under reflux in a special glassware.

Enzymatic extraction may be used to extract lipids from algae. Ezymatic extraction uses enzymes to degrade the cell walls with water acting as the solvent. The enzymatic extraction can be supported by ultrasonication.

Supercritical $CO_2$ can also be used as a solvent. In this method, $CO_2$ is liquefied under pressure and heated to the point that it becomes supercritical (having properties of both a liquid and a gas), allowing it to act as a solvent.

Fermentation Processes for Lipid Production

As used herein, the term the "fermentation process" refers to any fermentation process or any process comprising a fermentation step. A fermentation process includes, without limitation, fermentation processes used to produce alcohols (e.g., ethanol, methanol, butanol), organic acids (e.g., citric acid, acetic acid, itaconic acid, lactic acid, gluconic acid), ketones (e.g., acetone), amino acids (e.g., glutamic acid), gases (e.g., $H_2$ and $CO_2$), antibiotics (e.g., penicillin and tetracycline), enzymes, vitamins (e.g., riboflavin, beta-carotene), and hormones. Fermentation processes also include fermentation processes used in the consumable alcohol industry (e.g., beer and wine), dairy industry (e.g., fermented dairy products), leather industry and tobacco industry. Preferred fermentation processes include alcohol fermentation processes, as are well known in the art. Preferred fermentation processes are anaerobic fermentation processes, as are well known in the art. Suitable fermenting cells, typically microorganisms that are able to ferment, that is, convert, sugars such as glucose or maltose, directly or indirectly into the desired fermentation product.

Examples of fermenting microorganisms include fungal organisms such as yeast, preferably an oleaginous organism. As used herein, an "oleaginous organism" is one which accumulates at least 25% of its dry weight as triglycerides. As used herein, "yeast" includes *Saccharomyces* spp., *Saccharomyces* cerevisiae, Saccharomyces carlbergensis, Candida spp., Kluveromyces spp., Pichia spp., Hansenula spp., Trichoderma spp., Lipomyces starkey, and Yarrowia lipolytica. Preferred yeast include Yarrowia lipolytica or other oleaginous yeasts and strains of the Saccharomyces spp., and in particular, Saccharomyces cerevisiae.

In one embodiment, the fermenting microorganism is a transgenic organism that comprises one or more exogenous polynucleotides, wherein the transgenic organism has an increased level of one or more non-polar lipids when compared to a corresponding organism lacking the one or more exogenous polynucleotides. The transgenic microorganism is preferably grown under conditions that optimize activity of fatty acid biosynthetic genes and fatty acid acyltransferase genes. This leads to production of the greatest and the most economical yield of lipid. In general, media conditions that may be optimized include the type and amount of carbon source, the type and amount of nitrogen source, the carbon-to-nitrogen ratio, the oxygen level, growth temperature, pH, length of the biomass production phase, length of the lipid accumulation phase and the time of cell harvest.

Fermentation media must contain a suitable carbon source. Suitable carbon sources may include, but are not limited to: monosaccharides (e.g., glucose, fructose), disaccharides (e.g., lactose, sucrose), oligosaccharides, polysaccharides (e.g., starch, cellulose or mixtures thereof), sugar alcohols (e.g., glycerol) or mixtures from renewable feedstocks (e.g., cheese whey permeate, cornsteep liquor, sugar beet molasses, barley malt). Additionally, carbon sources may include alkanes, fatty acids, esters of fatty acids, monoglycerides, diglycerides, triglycerides, phospholipids and various commercial sources of fatty acids including vegetable oils (e.g., soybean oil) and animal fats. Additionally, the carbon substrate may include one-carbon substrates (e.g., carbon dioxide, methanol, formaldehyde, formate, carbon-containing amines) for which metabolic conversion into key biochemical intermediates has been demonstrated. Hence it is contemplated that the source of carbon utilized in the present invention may encompass a wide variety of carbon-containing substrates and will only be limited by the choice of the host microorganism. Although all of the above mentioned carbon substrates and mixtures thereof are expected to be suitable in the present invention, preferred carbon substrates are sugars and/or fatty acids. Most preferred is glucose and/or fatty acids containing between 10-22 carbons. Nitrogen may be supplied from an inorganic (e.g., $(NH_4)_2SO_4$) or organic source (e.g., urea, glutamate). In addition to appropriate carbon and nitrogen sources, the fermentation media may also contain suitable minerals, salts, cofactors, buffers, vitamins and other components known to those skilled in the art suitable for the growth of the microorganism and promotion of the enzymatic pathways necessary for lipid production.

A suitable pH range for the fermentation is typically between about pH 4.0 to pH 8.0, wherein pH 5.5 to pH 7.0 is preferred as the range for the initial growth conditions. The fermentation may be conducted under aerobic or anaerobic conditions, wherein microaerobic conditions are preferred.

Typically, accumulation of high levels of lipid in the cells of oleaginous microorganisms requires a two-stage process, since the metabolic state must be "balanced" between growth and synthesis/storage of fats. Thus, most preferably, a two-stage fermentation process is necessary for the production of lipids in microorganisms. In this approach, the first stage of the fermentation is dedicated to the generation and accumulation of cell mass and is characterized by rapid cell growth and cell division. In the second stage of the fermentation, it is preferable to establish conditions of nitrogen deprivation in the culture to promote high levels of lipid accumulation. The effect of this nitrogen deprivation is to reduce the effective concentration of AMP in the cells, thereby reducing the activity of the NAD-dependent isocitrate dehydrogenase of mitochondria. When this occurs, citric acid will accumulate, thus forming abundant pools of acetyl-CoA in the cytoplasm and priming fatty acid synthesis. Thus, this phase is characterized by the cessation of cell division followed by the synthesis of fatty acids and accumulation of TAGs.

Although cells are typically grown at about 30° C., some studies have shown increased synthesis of unsaturated fatty acids at lower temperatures. Based on process economics, this temperature shift should likely occur after the first phase of the two-stage fermentation, when the bulk of the microorganism's growth has occurred.

It is contemplated that a variety of fermentation process designs may be applied, where commercial production of lipids using the instant nucleic acids is desired. For example, commercial production of lipid from a recombinant microbial host may be produced by a batch, fed-batch or continuous fermentation process.

A batch fermentation process is a closed system wherein the media composition is set at the beginning of the process and not subject to further additions beyond those required for maintenance of pH and oxygen level during the process. Thus, at the beginning of the culturing process the media is inoculated with the desired organism and growth or metabolic activity is permitted to occur without adding additional substrates (i.e., carbon and nitrogen sources) to the medium. In batch processes the metabolite and biomass compositions of the system change constantly up to the time the culture is terminated. In a typical batch process, cells moderate through a static lag phase to a high-growth log phase and finally to a stationary phase, wherein the growth rate is diminished or halted. Left untreated, cells in the stationary phase will eventually die. A variation of the standard batch process is the fed-batch process, wherein the substrate is continually added to the fermentor over the course of the fermentation process. A fed-batch process is also suitable in the present invention. Fed-batch processes are useful when catabolite repression is apt to inhibit the metabolism of the cells or where it is desirable to have limited amounts of substrate in the media at any one time. Measurement of the substrate concentration in fed-batch systems is difficult and therefore may be estimated on the basis of the changes of measurable factors such as pH, dissolved oxygen and the partial pressure of waste gases (e.g., $CO_2$). Batch and fed-batch culturing methods are common and well known in the art and examples may be found in Brock, In Biotechnology: A Textbook of Industrial Microbiology, 2.sup.nd ed., Sinauer Associates, Sunderland, Mass., (1989); or Deshpande (1992).

Commercial production of lipid using the instant cells may also be accomplished by a continuous fermentation process, wherein a defined media is continuously added to a bioreactor while an equal amount of culture volume is removed simultaneously for product recovery. Continuous cultures generally maintain the cells in the log phase of growth at a constant cell density. Continuous or semi-continuous culture methods permit the modulation of one factor or any number of factors that affect cell growth or end product concentration. For example, one approach may limit the carbon source and allow all other parameters to moderate metabolism. In other systems, a number of factors affecting growth may be altered continuously while the cell concentration, measured by media turbidity, is kept constant. Continuous systems strive to maintain steady state growth and thus the cell growth rate must be balanced against cell loss due to media being drawn off the culture. Methods of modulating nutrients and growth factors for continuous culture processes, as well as techniques for maximizing the rate of product formation, are well known in the art of industrial microbiology and a variety of methods are detailed by Brock, supra.

Fatty acids, including PUFAs, may be found in the host microorganism as free fatty acids or in esterified forms such as acylglycerols, phospholipids, sulfolipids or glycolipids, and may be extracted from the host cell through a variety of means well-known in the art.

In general, means for the purification of fatty acids, including PUFAs, may include extraction with organic solvents, sonication, supercritical fluid extraction (e.g., using carbon dioxide), saponification and physical means such as presses, or combinations thereof. Of particular interest is extraction with methanol and chloroform in the presence of water (Bligh and Dyer, 1959). Where desirable, the aqueous layer can be acidified to protonate negatively-charged moieties and thereby increase partitioning of desired products into the organic layer. After extraction, the organic solvents can be removed by evaporation under a stream of nitrogen. When isolated in conjugated forms, the products may be enzymatically or chemically cleaved to release the free fatty acid or a less complex conjugate of interest, and can then be subject to further manipulations to produce a desired end product. Desirably, conjugated forms of fatty acids are cleaved with potassium hydroxide.

If further purification is necessary, standard methods can be employed. Such methods may include extraction, treatment with urea, fractional crystallization, HPLC, fractional distillation, silica gel chromatography, high-speed centrifugation or distillation, or combinations of these techniques. Protection of reactive groups such as the acid or alkenyl groups, may be done at any step through known techniques (e.g., alkylation, iodination). Methods used include methylation of the fatty acids to produce methyl esters. Similarly, protecting groups may be removed at any step. Desirably, purification of fractions containing GLA, STA, ARA, DHA and EPA may be accomplished by treatment with urea and/or fractional distillation.

An example of the use of plant biomass for the production of a biomass slurry using yeast is described in WO 2011/100272.

Uses of Lipids

The lipids produced by the methods described have a variety of uses. In some embodiments, the lipids are used as food oils. In other embodiments, the lipids are refined and used as lubricants or for other industrial uses such as the synthesis of plastics. In some preferred embodiments, the lipids are refined to produce biodiesel.

Biofuel

As used herein the term "biofuel" includes biodiesel and bioalcohol. Biodiesel can be made from oils derived from plants, algae and fungi. Bioalcohol is produced from the fermentation of sugar. This sugar can be extracted directly from plants (e.g., sugarcane), derived from plant starch (e.g., maize or wheat) or made from cellulose (e.g., wood, leaves or stems).

Biofuels currently cost more to produce than petroleum fuels. In addition to processing costs, biofuel crops require planting, fertilising, pesticide and herbicide applications, harvesting and transportation. Plants, algae and fungi of the present invention may reduce production costs of biofuel.

General methods for the production of biofuel can be found in, for example, Maher and Bressler, 2007; Greenwell et al., 2010; Karmakar et al., 2010; Alonso et al., 2010; Lee and Mohamed, 2010; Liu et al., 2010a; Gong and Jiang, 2011; Endalew et al., 2011; Semwal et al., 2011.

Bioalcohol

The production of biologically produced alcohols, for example, ethanol, propanol and butanol is well known. Ethanol is the most common bioalcohol.

The basic steps for large scale production of ethanol are: 1) microbial (for example, yeast) fermentation of sugars, 2) distillation, 3) dehydration, and optionally 4) denaturing. Prior to fermentation, some crops require saccharification or hydrolysis of carbohydrates such as cellulose and starch into sugars. Saccharification of cellulose is called cellulolysis. Enzymes can be used to convert starch into sugar.

Fermentation

Bioalcohol is produced by microbial fermentation of the sugar. Microbial fermentation will currently only work directly with sugars. Two major components of plants, starch and cellulose, are both made up of sugars, and can in principle be converted to sugars for fermentation.

Distillation

For the ethanol to be usable as a fuel, the majority of the water must be removed. Most of the water is removed by distillation, but the purity is limited to 95-96% due to the formation of a low-boiling water-ethanol azeotrope with maximum (95.6% m/m (96.5% v/v) ethanol and 4.4% m/m (3.5% v/v) water). This mixture is called hydrous ethanol and can be used as a fuel alone, but unlike anhydrous ethanol, hydrous ethanol is not miscible in all ratios with gasoline, so the water fraction is typically removed in further treatment in order to burn in combination with gasoline in gasoline engines.

Dehydration

Water can be removed from an azeotropic ethanol/water mixture by dehydration. Azeotropic distillation, used in many early fuel ethanol plants, consists of adding benzene or cyclohexane to the mixture. When these components are added to the mixture, it forms a heterogeneous azeotropic mixture in vapor-liquid-liquid equilibrium, which when distilled produces anhydrous ethanol in the column bottom, and a vapor mixture of water and cyclohexane/benzene. When condensed, this becomes a two-phase liquid mixture. Another early method, called extractive distillation, consists of adding a ternary component which will increase ethanol's relative volatility. When the ternary mixture is distilled, it will produce anhydrous ethanol on the top stream of the column.

A third method has emerged and has been adopted by the majority of modern ethanol plants. This new process uses molecular sieves to remove water from fuel ethanol. In this process, ethanol vapor under pressure passes through a bed of molecular sieve beads. The bead's pores are sized to allow absorption of water while excluding ethanol. After a period of time, the bed is regenerated under vacuum or in the flow of inert atmosphere (e.g. $N_2$) to remove the absorbed water. Two beds are often used so that one is available to absorb water while the other is being regenerated.

Biodiesel

The production of biodiesel, or alkyl esters, is well known. There are three basic routes to ester production from lipids: 1) Base catalysed transesterification of the lipid with alcohol; 2) Direct acid catalysed esterification of the lipid with methanol; and 3) Conversion of the lipid to fatty acids, and then to alkyl esters with acid catalysis.

Any method for preparing fatty acid alkyl esters and glyceryl ethers (in which one, two or three of the hydroxy groups on glycerol are etherified) can be used. For example, fatty acids can be prepared, for example, by hydrolyzing or saponifying triglycerides with acid or base catalysts, respectively, or using an enzyme such as a lipase or an esterase. Fatty acid alkyl esters can be prepared by reacting a fatty acid with an alcohol in the presence of an acid catalyst. Fatty acid alkyl esters can also be prepared by reacting a triglyceride with an alcohol in the presence of an acid or base catalyst. Glycerol ethers can be prepared, for example, by reacting glycerol with an alkyl halide in the presence of base, or with an olefin or alcohol in the presence of an acid catalyst.

In some preferred embodiments, the lipids are transesterified to produce methyl esters and glycerol. In some preferred embodiments, the lipids are reacted with an alcohol (such as methanol or ethanol) in the presence of a catalyst (for example, potassium or sodium hydroxide) to produce alkyl esters. The alkyl esters can be used for biodiesel or blended with petroleum based fuels.

The alkyl esters can be directly blended with diesel fuel, or washed with water or other aqueous solutions to remove various impurities, including the catalysts, before blending. It is possible to neutralize acid catalysts with base. However, this process produces salt. To avoid engine corrosion, it is preferable to minimize the salt concentration in the fuel additive composition. Salts can be substantially removed from the composition, for example, by washing the composition with water.

In another embodiment, the composition is dried after it is washed, for example, by passing the composition through a drying agent such as calcium sulfate.

In yet another embodiment, a neutral fuel additive is obtained without producing salts or using a washing step, by using a polymeric acid, such as Dowex 50™, which is a resin that contains sulfonic acid groups. The catalyst is easily removed by filtration after the esterification and etherification reactions are complete.

Plant Triacylglycerols as a Biofuel Source

Use of plant triacylglycerols for the production of biofuel is reviewed in Durrett et al. (2008). Briefly, plant oils are primarily composed of various triacylglycerols (TAGs), molecules that consist of three fatty acid chains (usually 18 or 16 carbons long) esterified to glycerol. The fatty acyl chains are chemically similar to the aliphatic hydrocarbons that make up the bulk of the molecules found in petrol and diesel. The hydrocarbons in petrol contain between 5 and 12 carbon atoms per molecule, and this volatile fuel is mixed with air and ignited with a spark in a conventional engine. In contrast, diesel fuel components typically have 10-15 carbon atoms per molecule and are ignited by the very high compression obtained in a diesel engine. However, most plant TAGs have a viscosity range that is much higher than that of conventional diesel: 17.3-32.9 $mm^2s^{-1}$ compared to 1.9-4.1 $mm^{2s-1}$, respectively (ASTM D975; Knothe and Steidley, 2005). This higher viscosity results in poor fuel atomization in modern diesel engines, leading to problems derived from incomplete combustion such as carbon deposition and coking (Ryan et al., 1984). To overcome this problem, TAGs are converted to less viscous fatty acid esters by esterification with a primary alcohol, most commonly methanol. The resulting fuel is commonly referred to as biodiesel and has a dynamic viscosity range from 1.9 to 6.0 $mm^2s^{-1}$ (ASTM D6751). The fatty acid methyl esters (FAMEs) found in biodiesel have a high energy density as reflected by their high heat of combustion, which is similar, if not greater, than that of conventional diesel (Knothe, 2005). Similarly, the cetane number (a measure of diesel ignition quality) of the FAMEs found in biodiesel exceeds that of conventional diesel (Knothe, 2005).

Plant oils are mostly composed of five common fatty acids, namely palmitate (16:0), stearate (18:0), oleate (18:1), linoleate (18:2) and linolenate (18:3), although, depending on the particular species, longer or shorter fatty acids may also be major constituents. These fatty acids differ from each other in terms of acyl chain length and number of double bonds, leading to different physical properties. Consequently, the fuel properties of biodiesel derived from a mixture of fatty acids are dependent on that composition. Altering the fatty acid profile can therefore improve fuel properties of biodiesel such as cold-temperature flow characteristics, oxidative stability and NOx emissions. Altering the fatty acid composition of TAGs may reduce the viscosity of the plant oils, eliminating the need for chemical modification, thus improving the cost-effectiveness of biofuels.

Most plant oils are derived from triacylglycerols stored in seeds. However, the present invention provides methods for also increasing oil content in vegetative tissues. The plant tissues of the present invention have an increased total lipid yield. Furthermore, the level of oleic acid is increased significantly while the polyunsaturated fatty acid alpha linolenic acid was reduced.

Once a leaf is developed, it undergoes a developmental change from sink (absorbing nutrients) to source (providing sugars). In food crops, most sugars are translocated out of source leaves to support growth of new leaves, roots and fruits. Because translocation of carbohydrate is an active process, there is a loss of carbon and energy during translocation. Furthermore, after the developing seed takes up carbon from the plant, there are additional carbon and energy losses associated with the conversion of carbohydrate into the oil, protein or other major components of the seed (Goffman et al., 2005). Plants of the present invention increase the energy content of leaves and/or stems such that the whole above-ground plant may be harvested and used to produce biofuel.

Algae as a Biofuel Source

Algae store oil inside the cell body, sometimes but not always in vesicles. This oil can be recovered in several relatively simple ways, including solvents, heat, and/or pressure. However, these methods typically recover only about 80% to 90% of the stored oil. Processes which offer more effective oil extraction methods which can recover close to 100% of the stored oil at low cost as known in the art. These processes include or consist of depolymerizing, such as biologically breaking the walls of the algal cell and/or oil vesicles, if present, to release the oil from the oil-producing algae.

In addition, a large number of viruses exist which invade and rupture algae cells, and can thereby release the contents of the cell in particular stored oil or starch. Such viruses are an integral part of the algal ecosystem, and many of the viruses are specific to a single type of algae. Specific examples of such viruses include the *chlorella* virus PBCV-1 (Paramecium Bursaria Chlorella Virus) which is specific to certain *Chlorella* algae, and cyanophages such as SM-1, P-60, and AS-1 specific to the blue-green algae *Synechococcus*. The particular virus selected will depend on the particular species of algae to be used in the growth process. One aspect of the present invention is the use of such a virus to rupture the algae so that oil contained inside the algae cell wall can be recovered. In another detailed aspect of the present invention, a mixture of biological agents can be used to rupture the algal cell wall and/or oil vesicles.

Mechanical crushing, for example, an expeller or press, a hexane or butane solvent recovery step, supercritical fluid extraction, or the like can also be useful in extracting the oil from oil vesicles of the oil-producing algae. Alternatively, mechanical approaches can be used in combination with biological agents in order to improve reaction rates and/or separation of materials. Regardless of the particular biological agent or agents chosen such can be introduced in amounts which are sufficient to serve as the primary mechanism by which algal oil is released from oil vesicles in the oil-producing algae, i.e. not a merely incidental presence of any of these.

Once the oil has been released from the algae it can be recovered or separated 16 from a slurry of algae debris material, for example, cellular residue, oil, enzyme, by-products, etc. This can be done by sedimentation or centrifugation, with centrifugation generally being faster. Starch production can follow similar separation processes.

An algal feed can be formed from a biomass feed source as well as an algal feed source. Biomass from either algal or terrestrial sources can be depolymerized in a variety of ways such as, but not limited to saccharification, hydrolysis or the like. The source material can be almost any sufficiently voluminous cellulose, lignocellulose, polysaccharide or carbohydrate, glycoprotein, or other material making up the cell wall of the source material.

The fermentation stage can be conventional in its use of yeast to ferment sugar to alcohol. The fermentation process produces carbon dioxide, alcohol, and algal husks. All of these products can be used elsewhere in the process and systems of the present invention, with substantially no unused material or wasted heat. Alternatively, if ethanol is so produced, it can be sold as a product or used to produce ethyl acetate for the transesterification process. Similar considerations would apply to alcohols other than ethanol.

Algal oil can be converted to biodiesel through a process of direct hydrogenation or transesterification of the algal oil. Algal oil is in a similar form as most vegetable oils, which are in the form of triglycerides. A triglyceride consists of three fatty acid chains, one attached to each of the three carbon atoms in a glycerol backbone. This form of oil can be burned directly. However, the properties of the oil in this form are not ideal for use in a diesel engine, and without modification, the engine will soon run poorly or fail. In accordance with the present invention, the triglyceride is converted into biodiesel, which is similar to but superior to petroleum diesel fuel in many respects.

One process for converting the triglyceride to biodiesel is transesterification, and includes reacting the triglyceride with alcohol or other acyl acceptor to produce free fatty acid esters and glycerol. The free fatty acids are in the form of fatty acid alkyl esters (FAAE).

With the chemical process, additional steps are needed to separate the catalyst and clean the fatty acids. In addition, if ethanol is used as the acyl acceptor, it must be essentially dry to prevent production of soap via saponification in the process, and the glycerol must be purified. The biological process, by comparison, can accept ethanol in a less dry state and the cleaning and purification of the biodiesel and glycerol are much easier.

Transesterification often uses a simple alcohol, typically methanol derived from petroleum. When methanol is used the resultant biodiesel is called fatty acid methyl ester (FAME) and most biodiesel sold today, especially in Europe, is FAME. However, ethanol can also be used as the alcohol in transesterification, in which case the biodiesel is fatty acid ethyl ester (FAEE). In the US, the two types are usually not distinguished, and are collectively known as fatty acid alkyl esters (FAAE), which as a generic term can apply regardless of the acyl acceptor used. Direct hydrogenation can also be utilized to convert at least a portion of the algal oil to a biodiesel. As such, in one aspect, the biodiesel product can include an alkane.

The algal triglyceride can also be converted to biodiesel by direct hydrogenation. In this process, the products are alkane chains, propane, and water. The glycerol backbone is hydrogenated to propane, so there is substantially no glycerol produced as a byproduct. Furthermore, no alcohol or transesterification catalysts are needed. All of the biomass can be used as feed for the oil-producing algae with none needed for fermentation to produce alcohol for transesterification. The resulting alkanes are pure hydrocarbons, with no oxygen, so the biodiesel produced in this way has a slightly higher energy content than the alkyl esters, degrades more slowly, does not attract water, and has other desirable chemical properties.

Feedstuffs

The present invention includes compositions which can be used as feedstuffs. For purposes of the present invention, "feedstuffs" include any food or preparation for human or animal consumption (including for enteral and/or parenteral consumption) which when taken into the body: (1) serve to nourish or build up tissues or supply energy, and/or (2) maintain, restore or support adequate nutritional status or metabolic function. Feedstuffs of the invention include nutritional compositions for babies and/or young children.

Feedstuffs of the invention comprise for example, a cell of the invention, a plant of the invention, the plant part of the invention, the seed of the invention, an extract of the invention, the product of a method of the invention, the product of a fermentation process of the invention, or a composition along with a suitable carrier(s). The term "carrier" is used in its broadest sense to encompass any component which may or may not have nutritional value. As the person skilled in the art will appreciate, the carrier must be suitable for use (or used in a sufficiently low concentration) in a feedstuff, such that it does not have deleterious effect on an organism which consumes the feedstuff.

The feedstuff of the present invention comprises a lipid produced directly or indirectly by use of the methods, cells or organisms disclosed herein. The composition may either be in a solid or liquid form. Additionally, the composition may include edible macronutrients, vitamins, and/or minerals in amounts desired for a particular use. The amounts of these ingredients will vary depending on whether the composition is intended for use with normal individuals or for use with individuals having specialized needs such as individuals suffering from metabolic disorders and the like.

Examples of suitable carriers with nutritional value include, but are not limited to, macronutrients such as edible fats, carbohydrates and proteins. Examples of such edible fats include, but are not limited to, coconut oil, borage oil, fungal oil, black current oil, soy oil, and mono- and di-glycerides. Examples of such carbohydrates include, but are not limited to, glucose, edible lactose, and hydrolyzed starch. Additionally, examples of proteins which may be utilized in the nutritional composition of the invention include, but are not limited to, soy proteins, electrodialysed whey, electrodialysed skim milk, milk whey, or the hydrolysates of these proteins.

With respect to vitamins and minerals, the following may be added to the feedstuff compositions of the present invention, calcium, phosphorus, potassium, sodium, chloride, magnesium, manganese, iron, copper, zinc, selenium, iodine, and vitamins A, E, D, C, and the B complex. Other such vitamins and minerals may also be added.

The components utilized in the feedstuff compositions of the present invention can be of semi-purified or purified origin. By semi-purified or purified is meant a material which has been prepared by purification of a natural material or by de novo synthesis.

A feedstuff composition of the present invention may also be added to food even when supplementation of the diet is not required. For example, the composition may be added to food of any type, including, but not limited to, margarine, modified butter, cheeses, milk, yogurt, chocolate, candy, snacks, salad oils, cooking oils, cooking fats, meats, fish and beverages.

The genus *Saccharomyces* spp is used in both brewing of beer and wine making and also as an agent in baking, particularly bread. Yeast is a major constituent of vegetable extracts. Yeast is also used as an additive in animal feed. It will be apparent that genetically modified yeast strains can be provided which are adapted to synthesize lipid as described herein. These yeast strains can then be used in food stuffs and in wine and beer making to provide products which have enhanced lipid content.

Additionally, lipid produced in accordance with the present invention or host cells transformed to contain and express the subject genes may also be used as animal food supplements to alter an animal's tissue or milk fatty acid composition to one more desirable for human or animal consumption. Examples of such animals include sheep, cattle, horses and the like.

Furthermore, feedstuffs of the invention can be used in aquaculture to increase the levels of fatty acids in fish for human or animal consumption.

Preferred feedstuffs of the invention are the plants, seed and other plant parts such as leaves, fruits and stems which may be used directly as food or feed for humans or other animals. For example, animals may graze directly on such plants grown in the field, or be fed more measured amounts in controlled feeding. The invention includes the use of such plants and plant parts as feed for increasing the polyunsaturated fatty acid levels in humans and other animals.

Compositions

The present invention also encompasses compositions, particularly pharmaceutical compositions, comprising one or more lipids produced using the methods of the invention.

A pharmaceutical composition may comprise one or more of the lipids, in combination with a standard, well-known, non-toxic pharmaceutically-acceptable carrier, adjuvant or vehicle such as phosphate-buffered saline, water, ethanol, polyols, vegetable oils, a wetting agent, or an emulsion such as a water/oil emulsion. The composition may be in either a liquid or solid form. For example, the composition may be in the form of a tablet, capsule, ingestible liquid, powder, topical ointment or cream. Proper fluidity can be maintained for example, by the maintenance of the required particle size in the case of dispersions and by the use of surfactants. It may also be desirable to include isotonic agents for example, sugars, sodium chloride, and the like. Besides such inert diluents, the composition can also include adjuvants such as wetting agents, emulsifying and suspending agents, sweetening agents, flavoring agents and perfuming agents.

Suspensions, in addition to the active compounds, may comprise suspending agents such as ethoxylated isostearyl alcohols, polyoxyethylene sorbitol and sorbitan esters, microcrystalline cellulose, aluminum metahydroxide, bentonite, agar-agar, and tragacanth, or mixtures of these substances.

Solid dosage forms such as tablets and capsules can be prepared using techniques well known in the art. For example, lipid produced in accordance with the present invention can be tableted with conventional tablet bases such as lactose, sucrose, and cornstarch in combination with binders such as acacia, cornstarch or gelatin, disintegrating agents such as potato starch or alginic acid, and a lubricant such as stearic acid or magnesium stearate. Capsules can be prepared by incorporating these excipients into a gelatin capsule along with antioxidants and the relevant lipid(s).

For intravenous administration, the lipids produced in accordance with the present invention or derivatives thereof may be incorporated into commercial formulations.

A typical dosage of a particular fatty acid is from 0.1 mg to 20 g, taken from one to five times per day (up to 100 g daily) and is preferably in the range of from about 10 mg to about 1, 2, 5, or 10 g daily (taken in one or multiple doses). As known in the art, a minimum of about 300 mg/day of fatty acid, especially polyunsaturated fatty acid, is desirable. However, it will be appreciated that any amount of fatty acid will be beneficial to the subject.

Possible routes of administration of the pharmaceutical compositions of the present invention include for example, enteral and parenteral. For example, a liquid preparation may be administered orally. Additionally, a homogenous mixture can be completely dispersed in water, admixed under sterile conditions with physiologically acceptable diluents, preservatives, buffers or propellants to form a spray or inhalant.

The dosage of the composition to be administered to the subject may be determined by one of ordinary skill in the art and depends upon various factors such as weight, age, overall health, past history, immune status, etc., of the subject.

Additionally, the compositions of the present invention may be utilized for cosmetic purposes. The compositions may be added to pre-existing cosmetic compositions, such that a mixture is formed, or a fatty acid produced according to the invention may be used as the sole "active" ingredient in a cosmetic composition.

Polypeptides

The terms "polypeptide" and "protein" are generally used interchangeably.

A polypeptide or class of polypeptides may be defined by the extent of identity (% identity) of its amino acid sequence to a reference amino acid sequence, or by having a greater % identity to one reference amino acid sequence than to another. The % identity of a polypeptide to a reference amino acid sequence is typically determined by GAP analysis (Needleman and Wunsch, 1970; GCG program) with parameters of a gap creation penalty=5, and a gap extension penalty=0.3. The query sequence is at least 100 amino acids in length and the GAP analysis aligns the two sequences over a region of at least 100 amino acids. Even more preferably, the query sequence is at least 250 amino acids in length and the GAP analysis aligns the two sequences over a region of at least 250 amino acids. Even more preferably, the GAP analysis aligns two sequences over their entire length. The polypeptide or class of polypeptides may have the same enzymatic activity as, or a different activity than, or lack the activity of, the reference polypeptide. Preferably, the polypeptide has an enzymatic activity of at least 10% of the activity of the reference polypeptide.

As used herein a "biologically active fragment" is a portion of a polypeptide of the invention which maintains a defined activity of a full-length reference polypeptide for example, MGAT activity. Biologically active fragments as used herein exclude the full-length polypeptide. Biologically active fragments can be any size portion as long as they maintain the defined activity. Preferably, the biologically active fragment maintains at least 10% of the activity of the full length polypeptide.

With regard to a defined polypeptide or enzyme, it will be appreciated that % identity figures higher than those provided herein will encompass preferred embodiments. Thus, where applicable, in light of the minimum % identity figures, it is preferred that the polypeptide/enzyme comprises an amino acid sequence which is at least 60%, more preferably at least 65%, more preferably at least 70%, more preferably at least 75%, more preferably at least 80%, more preferably at least 85%, more preferably at least 90%, more preferably at least 91%, more preferably at least 92%, more preferably at least 93%, more preferably at least 94%, more preferably at least 95%, more preferably at least 96%, more preferably at least 97%, more preferably at least 98%, more preferably at least 99%, more preferably at least 99.1%, more preferably at least 99.2%, more preferably at least 99.3%, more preferably at least 99.4%, more preferably at least 99.5%, more preferably at least 99.6%, more preferably at least 99.7%, more preferably at least 99.8%, and even more preferably at least 99.9% identical to the relevant nominated SEQ ID NO.

Amino acid sequence mutants of the polypeptides defined herein can be prepared by introducing appropriate nucleotide changes into a nucleic acid defined herein, or by in vitro synthesis of the desired polypeptide. Such mutants include for example, deletions, insertions, or substitutions of residues within the amino acid sequence. A combination of deletions, insertions and substitutions can be made to arrive at the final construct, provided that the final polypeptide product possesses the desired characteristics.

Mutant (altered) polypeptides can be prepared using any technique known in the art, for example, using directed evolution or rathional design strategies (see below). Products derived from mutated/altered DNA can readily be screened using techniques described herein to determine if they possess fatty acid acyltransferase activity, for example, MGAT, DGAT, or GPAT/phosphatase activity.

In designing amino acid sequence mutants, the location of the mutation site and the nature of the mutation will depend on characteristic(s) to be modified. The sites for mutation can be modified individually or in series for example, by (1) substituting first with conservative amino acid choices and then with more radical selections depending upon the results achieved, (2) deleting the target residue, or (3) inserting other residues adjacent to the located site.

Amino acid sequence deletions generally range from about 1 to 15 residues, more preferably about 1 to 10 residues and typically about 1 to 5 contiguous residues.

Substitution mutants have at least one amino acid residue in the polypeptide removed and a different residue inserted in its place. The sites of greatest interest for substitutional mutagenesis include sites identified as the active site(s). Other sites of interest are those in which particular residues obtained from various strains or species are identical. These positions may be important for biological activity. These sites, especially those falling within a sequence of at least three other identically conserved sites, are preferably substituted in a relatively conservative manner. Such conservative substitutions are shown in Table 1 under the heading of "exemplary substitutions".

In a preferred embodiment a mutant/variant polypeptide has only, or not more than, one or two or three or four conservative amino acid changes when compared to a naturally occurring polypeptide. Details of conservative amino acid changes are provided in Table 1. As the skilled person would be aware, such minor changes can reasonably be predicted not to alter the activity of the polypeptide when expressed in a recombinant cell.

TABLE 1

Exemplary substitutions.

| Original Residue | Exemplary Substitutions |
|---|---|
| Ala (A) | val; leu; ile; gly |
| Arg (R) | lys |
| Asn (N) | gln; his |
| Asp (D) | glu |
| Cys (C) | ser |
| Gln (Q) | asn; his |
| Glu (E) | asp |
| Gly (G) | pro, ala |
| His (H) | asn; gln |
| Ile (I) | leu; val; ala |
| Leu (L) | ile; val; met; ala; phe |
| Lys (K) | arg |
| Met (M) | leu; phe |
| Phe (F) | leu; val; ala |
| Pro (P) | gly |
| Ser (S) | thr |
| Thr (T) | ser |
| Trp (W) | tyr |
| Tyr (Y) | trp; phe |
| Val (V) | ile; leu; met; phe, ala |

Directed Evolution

In directed evolution, random mutagenesis is applied to a protein, and a selection regime is used to pick out variants that have the desired qualities, for example, increased fatty acid acyltransferase activity. Further rounds of mutation and selection are then applied. A typical directed evolution strategy involves three steps:

1) Diversification: The gene encoding the protein of interest is mutated and/or recombined at random to create a large library of gene variants. Variant gene libraries can be constructed through error prone PCR (see, for example, Leung, 1989: Cadwell and Joyce, 1992), from pools of DNaseI digested fragments prepared from parental templates (Stemmer, 1994a, Stemmer, 1994b; Crameri et al., 1998; Coco et al., 2001) from degenerate oligonucleotides (Ness et al., 2002, Coco, 2002) or from mixtures of both, or even from undigested parental templates (Zhao et al., 1998; Eggert et al., 2005; Jézéquek et al., 2008) and are usually assembled through PCR. Libraries can also be made from parental sequences recombined in vivo or in vitro by either homologous or non-homologous recombination (Ostermeier et al., 1999; Volkov et al., 1999; Sieber et al., 2001). Variant gene libraries can also be constructed by sub-cloning a gene of interest into a suitable vector, transforming the vector into a "mutator" strain such as the *E. coli* XL-1 red (Stratagene) and propagating the transformed bacteria for a suitable number of generations. Variant gene libraries can also be constructed by subjecting the gene of interest to DNA shuffling (i.e., in vitro homologous recombination of pools of selected mutant genes by random fragmentation and reassembly) as broadly described by Harayama (1998).

2) Selection: The library is tested for the presence of mutants (variants) possessing the desired property using a screen or selection. Screens enable the identification and isolation of high-performing mutants by hand, while selections automatically eliminate all nonfunctional mutants. A screen may involve screening for the presence of known conserved amino acid motifs. Alternatively, or in addition, a screen may involve expressing the mutated polynucleotide in a host organism or part thereof and assaying the level of fatty acid acyltransferase activity by, for example, quantifying the level of resultant product in lipid extracted from the organism or part thereof, and determining the level of product in the extracted lipid from the organism or part thereof relative to a corresponding organism or part thereof lacking the mutated polynucleotide and optionally, expressing the parent (unmutated) polynucleotide. Alternatively, the screen may involve feeding the organism or part thereof labelled substrate and determining the level of substrate or product in the organism or part thereof relative to a corresponding organism or part thereof lacking the mutated polynucleotide and optionally, expressing the parent (unmutated) polynucleotide.

3) Amplification: The variants identified in the selection or screen are replicated many fold, enabling researchers to sequence their DNA in order to understand what mutations have occurred.

Together, these three steps are termed a "round" of directed evolution. Most experiments will entail more than one round. In these experiments, the "winners" of the previous round are diversified in the next round to create a new library. At the end of the experiment, all evolved protein or polynucleotide mutants are characterized using biochemical methods.

Rational Design

A protein can be designed rationally, on the basis of known information about protein structure and folding. This can be accomplished by design from scratch (de novo design) or by redesign based on native scaffolds (see, for example, Helling a, 1997; and Lu and Berry, Protein Structure Design and Engineering, Handbook of Proteins 2, 1153-1157 (2007)). Protein design typically involves identifying sequences that fold into a given or target structure and can be accomplished using computer models. Computational protein design algorithms search the sequence-conformation space for sequences that are low in energy when folded to the target structure. Computational protein design algorithms use models of protein energetics to evaluate how mutations would affect a protein's structure and function. These energy functions typically include a combination of molecular mechanics, statistical (i.e. knowledge-based), and other empirical terms. Suitable available software includes IPRO (Interative Protein Redesign and Optimization), EGAD (A Genetic Algorithm for Protein Design), Rosetta Design, Sharpen, and Abalone.

Also included within the scope of the invention are polypeptides defined herein which are differentially modified during or after synthesis for example, by biotinylation, benzylation, glycosylation, acetylation, phosphorylation, amidation, derivatization by known protecting/blocking groups, proteolytic cleavage, linkage to an antibody molecule or other cellular ligand, etc. These modifications may serve to increase the stability and/or bioactivity of the polypeptide of the invention.

Identification of Fatty Acid Acyltransferases

In one aspect, the invention provides a method for identifying a nucleic acid molecule encoding a fatty acid acyltransferase having an increased ability to produce MAG, DAG and/or TAG in a cell.

The method comprises obtaining a cell comprising a nucleic acid molecule encoding a fatty acid acyltransferase operably linked to a promoter which is active in the cell. The nucleic acid molecule may encode a naturally occurring fatty acid acyltransferase such as MGAT, GPAT and/or DGAT, or a mutant(s) thereof. Mutants may be engineered using standard procedures in the art (see above) such as by performing random mutagenesis, targeted mutagenesis, or saturation mutagenesis on known genes of interest, or by subjecting different genes to DNA shuffling. For example, a polynucleotide comprising a sequence selected from any one of SEQ ID NOs:1 to 44 which encodes a MGAT may be mutated and/or recombined at random to create a large library of gene variants (mutants) using for example, error-prone PCR and/or DNA shuffling. Mutants may be selected for further investigation on the basis that they comprise a conserved amino acid motif. For example, in the case of a candidate nucleic acid encoding a MGAT, a skilled person may determine whether it comprises a sequence as provided in SEQ ID NOs:220, 221, 222, 223, and/or 224 before testing whether the nucleic acid encodes a functional MGAT mutant (by for example, transfection into a host cell, such as a plant cell and assaying for fatty acid acyltransferase (i.e., MGAT) activity as described herein).

Direct PCR sequencing of the nucleic acid or a fragment thereof may be used to determine the exact nucleotide sequence and deduce the corresponding amino acid sequence and thereby identify conserved amino acid sequences. Degenerate primers based on conserved amino acid sequences may be used to direct PCR amplification. Degenerate primers can also be used as probes in DNA hybridization assays. Alternatively, the conserved amino acid sequence(s) may be detected in protein hybridization assays that utilize for example, an antibody that specifically binds to the conserved amino acid sequences(s), or a substrate that specifically binds to the conserved amino acid sequences(s) such as, for example, a lipid that binds FLXLXXXN (a putative neutral lipid binding domain; SEQ ID NO:224).

In one embodiment, the nucleic acid molecule comprises a sequence of nucleotides encoding a MGAT. The sequence of nucleotides may i) comprise a sequence selected from any one of SEQ ID NOs:1 to 44, ii) encode a polypeptide comprising amino acids having a sequence as provided in any one of SEQ ID NOs:45 to 82, or a biologically active fragment thereof, iii) be at least 50% identical to i) or ii), or iv) hybridize to any one of i) to iii) under stringent conditions. In another or additional embodiment, the nucleic acid molecule comprises a sequence of nucleotides encoding one or more conserved DGAT2 and/or MGAT1/2 amino acid sequences as provided in SEQ ID NOs:220, 221, 222, 223, and 224. In a preferred embodiment, the nucleic acid molecule comprises a sequence of nucleotides encoding the conserved amino acid sequences provided in SEQ ID NO:220 and/or SEQ ID NO:224.

In another embodiment, the nucleic acid molecule comprises a sequence of nucleotides encoding a GPAT, preferably a GPAT which has phosphatase activity. The sequence of nucleotides may i) comprise a sequence selected from any one of SEQ ID NOs:84 to 141, ii) encode a polypeptide comprising amino acids having a sequence as provided in any one of SEQ ID NOs:144 to 201, or a biologically active fragment thereof, iii) be at least 50% identical to i) or ii), or iv) hybridize to any one of i) to iii) under stringent conditions. In another or additional embodiment, the nucleic acid molecule comprises a sequence of nucleotides encoding one or more conserved GPAT amino acid sequences as provided in SEQ ID NOs:225, 226, and 227, or a sequence of amino acids which is at least 50%, preferably at least 60%, more preferably at least 65% identical thereto.

In another embodiment, the nucleic acid molecule comprises a sequence of nucleotides encoding a DGAT2. The sequence of nucleotides may comprise i) a sequence of nucleotides selected from any one of SEQ ID NO:204 to 211, ii) encode a polypeptide comprising amino acids having a sequence as provided in any one of SEQ ID NO:212 to 219, or a biologically active fragment thereof, iii) be at least 50% identical to i) or ii), or iv) hybridize to any one of i) to iii) under stringent conditions. In a preferred embodiment, the DGAT2 comprises a sequence of nucleotides of SEQ ID NO:204 and/or a sequence of nucleotides encoding a polypeptide comprising amino acids having a sequence as provided in SEQ ID NO:212.

A cell comprising a nucleic acid molecule encoding a fatty acid acyltransferase operably linked to a promoter which is active in the cell may be obtained using standard procedures in the art such as by introducing the nucleic acid molecule into a cell by, for example, calcium phosphate precipitation, polyethylene glycol treatment, electroporation, and combinations of these treatments. Other methods of cell transformation can also be used and include, but are not limited to, the introduction of DNA into plants by direct DNA transfer or injection. Transformed plant cells may also be obtained using *Agrobacterium*-mediated transfer and acceleration methods as described herein.

The method further comprises determining if the level of MAG, DAG and/or TAG produced in the cell is increased when compared to a corresponding cell lacking the nucleic acid using known techniques in the art such as those exemplified in Example 1. For instance, lipids can be extracted in a chloroform/methanol solution, dried and separated by thin layer chromatography (TLC). Identities of TAG, DAG, MAG, free fatty acid, and other lipids can be verified with internal lipid standards after staining with iodine vapor. The resultant chromatograms can analyzed using a PhosphorImager and the amount of MAG, DAG and TAG quantified on the basis of the known amount of internal standards, or alternatively, the cells may be fed sn-2 monooleoylglycerol[$^{14}$C] or [$^{14}$C]glycerol-3-phosphate and associated radioactivity quantitated by liquid scintillation counting (i.e., the amount of labelled MAG, DAG and TAG is quantified).

The method further comprises identifying a nucleic acid molecule encoding a fatty acid acyltransferase having an increased ability to produce MAG, DAG and/or TAG in a cell. In a preferred embodiment, the fatty acid acyltransferase catalyzes an enzyme reaction in the MGAT pathway. In a further preferred embodiment, DAG is increased via the MGAT pathway (i.e., acylation of MAG with fatty acyl-CoA is catalysed by a MGAT to form DAG). In another or additional embodiment, the substrate MAG is produced by a GPAT which also has phosphatase activity and/or DAG is acylated with fatty acyl-CoA by a DGAT and/or a MGAT having DGAT activity to form TAG.

Gloss

Certain aspects of the invention relate to measuring the glossiness of vegetative material as a marker for the level of lipid in the material, with higher glossiness levels being associated with higher lipid levels.

The gloss of the vegetative material can be determined using known procedures. Glossmeters (reflectometers) provide a quantifiable way of measuring gloss intensity ensuring consistency of measurement by defining the precise illumination and viewing conditions. The configuration of both illumination source and observation reception angles allows measurement over a small range of the overall reflection angle. The measurement results of a glossmeter are related to the amount of reflected light from a black glass standard with a defined refractive index. The ratio of reflected to incident light for the specimen, compared to the ratio for the gloss standard, is recorded as gloss units.

The measurement scale, Gloss Units (GU), of a glossmeter is a scaling based on a highly polished reference black glass standard with a defined refractive index having a specular reflectance of 100GU at the specified angle. This standard is used to establish an upper point calibration of 100 with the lower end point established at 0 on a perfectly matt surface. This scaling is suitable for most non-metallic materials.

The optimal or expected level of glossiness of vegetative material is likely to vary between plant species. The skilled person can readily analyse the lipid content of vegetative material of different plants of the invention and identify a suitable pre-determined level of glossiness that can be used as a standard in the field for assessing the best time to harvest a vegetative material from a particular plant species.

EXAMPLES

Example 1

General Materials and Methods

Expression of Genes in Plant Cells in a Transient Expression System

Genes were expressed in plant cells using a transient expression system essentially as described by Voinnet et al. (2003) and Wood et al. (2009). Binary vectors containing the coding region to be expressed by a strong constitutive e35S promoter containing a duplicated enhancer region were introduced into *Agrobacterium tumefaciens* strain AGL1. A chimeric binary vector, 35S:p19, for expression of the p19 viral silencing suppressor was separately introduced into AGL1, as described in WO2010/057246. A chimeric binary vector, 35S:V2, for expression of the V2 viral silencing suppressor was separately introduced into AGL1. The recombinant cells were grown to stationary phase at 28° C. in LB broth supplemented with 50 mg/L kanamycin and 50 mg/L rifampicin. The bacteria were then pelleted by centrifugation at 5000 g for 5 min at room temperature before being resuspended to OD600=1.0 in an infiltration buffer containing 10 mM MES pH 5.7, 10 mM MgCl$_2$ and 100 uM acetosyringone. The cells were then incubated at 28° C. with shaking for 3 hours after which the OD600 was measured and a volume of each culture, including the viral suppressor construct 35S:p19 or 35S:V2, required to reach a final concentration of OD600=0.125 added to a fresh tube. The final volume was made up with the above buffer. Leaves were then infiltrated with the culture mixture and the plants were typically grown for a further three to five days after infiltration before leaf discs were recovered for either purified cell lysate preparation or total lipid isolation.

Purified Leaf Lysate Assay

*Nicotiana benthamiana* leaf tissues previously infiltrated as described above were ground in a solution containing 0.1 M potassium phosphate buffer (pH 7.2) and 0.33 M sucrose using a glass homogenizer. Leaf homogenate was centrifuged at 20,000 g for 45 minutes at 4° C. after which each supernatant was collected. Protein content in each supernatant was measured according to Bradford (1976) using a Wallac1420 multi-label counter and a Bio-Rad Protein Assay dye reagent (Bio-Rad Laboratories, Hercules, Calif. USA). Acyltransferase assays used 100 µg protein according to Cao et al. (2007) with some modifications. The reaction medium contained 100 mM Tris-HCl (pH 7.0), 5 mM MgCl$_2$, 1 mg/mL BSA (fatty acid-free), 200 mM sucrose, 40 mM cold oleoyl-CoA, 16.4 µM sn-2 monooleoylglycerol[$^{14}$C] (55mCi/mmol, American Radiochemicals, Saint Louis, Mo. USA) or 6.0 µM [$^{14}$C]glycerol-3-phosphate (G-3-P) disodium salt (150 mCi/mmol, American Radiochemicals). The assays were carried out for 7.5, 15, or 30 minutes.

Lipid Analysis

In summary, the methods used for analysing lipids in seeds or vegetative tissues were as follows:

*Arabidopsis* Seed and any Other Similar Sized Seed:

(i) Fatty acid composition—direct methylation of fatty acids in seeds, without crushing of seeds.

(ii) Total fatty acid or TAG quantitation—direct methylation of fatty acids in seeds, without crushing of seeds, with use of a 17:0 TAG standard.

Canola seed, *Camelina* seed, and any other larger sized seeds:

(i) Single seed fatty acid composition—direct methylation of fatty acids in seed after breaking seed coat.

(ii) Pooled seed-fatty acid composition of total extracted lipid—crushing seeds in $CHCl_3$/MeOH and methylation of aliquots of the extracted lipid.

(iii) Pooled seed-total lipid content (seed oil content)—two times lipid extraction for complete recovery of seed lipids after crushing seeds from known amount of dessicated seeds, with methylation of lipids from known amount of seeds together with 17:0 fatty acids as internal standard.

(iv) Pooled seed-purified TAG quantitation—two times lipid extraction for complete recovery of seed lipids after crushing seeds, from known amount of dessicated seeds, TAG fractionation from the lipid using TLC, and direct methylation of TAG in silica using 17:0 TAG as internal standard.

Leaf Samples:

(i) Fatty acid composition of total lipid—direct methylation of fatty acids in freeze-dried samples.

(ii) Total lipid quantitation—direct methylation of fatty acids in known weight of freeze-dried samples, with 17:0 FFA.

(iii) TAG quantitation—because of the presence of substantial amounts of polar lipids in leaves, TAG was fractionated by TLC from extracted total lipids, and methylated in the presence of 17:0 TAG internal standard. Steps: Freeze dry samples, weighing, lipid extraction, fractionation of TAG from known amount of total lipids, direct methylation of TAG in silica together with 17:0 TAG as internal standard.

The methods are detailed as follows:

Analysis of Oil Content in *Arabidposis* Seeds

Where seed oil content was to be determined in small seeds such as *Arabidopsis* seeds, seeds were dried in a desiccator for 24 hours and approximately 4 mg of seed was transferred to a 2 ml glass vial containing Teflon-lined screw cap. 0.05 mg triheptadecanoin dissolved in 0.1 ml toluene was added to the vial as internal standard. Seed FAME were prepared by adding 0.7 ml of 1N methanolic HCl (Supelco) to the vial containing seed material. Crushing of the seeds was not necessary with small seeds such as *Arabidopsis* seeds. The mixture was vortexed briefly and incubated at 80° C. for 2 hours. After cooling to room temperature, 0.3 ml of 0.9% NaCl (w/v) and 0.1 ml hexane was added to the vial and mixed well for 10 minutes in a Heidolph Vibramax 110. The FAME was collected into a 0.3 ml glass insert and analysed by GC with a flame ionization detector (FID) as mentioned earlier.

The peak area of individual FAME were first corrected on the basis of the peak area responses of a known amount of the same FAMEs present in a commercial standard GLC-411 (NU-CHEK PREP, INC., USA). GLC-411 contains equal amounts of 31 fatty acids (% by weight), ranging from C8:0 to C22:6. In case of fatty acids which were not present in the standard, the peak area responses of the most similar FAME was taken. For example, the peak area response of FAMEs of 16:1d9 was used for 16:1d7 and the FAME response of C22:6 was used for C22:5. The corrected areas were used to calculate the mass of each FAME in the sample by comparison to the internal standard mass. Oil is stored mainly in the form of TAG and its weight was calculated based on FAME weight. Total moles of glycerol was determined by calculating moles of each FAME and dividing total moles of FAMEs by three. TAG was calculated as the sum of glycerol and fatty acyl moieties using a relation: % oil by weight=100×((41× total mol FAME/3)+(total g FAME−(15× total mol FAME)))/g seed, where 41 and 15 are molecular weights of glycerol moiety and methyl group, respectively.

Analysis of Oil Content in *Camelina* Seeds and Canola Seeds by Extraction

After harvest at plant maturity, *Camelina* or canola seeds were dessicated by storing the seeds for 24 hours at room temperature in a dessicator containing silica gel as dessicant. Moisture content of the seeds is typically 6-8%. Total lipids were extracted from known weights of the dessicated seeds by crushing the seeds using a mixture of chloroform and methanol (2/1 v/v) in an eppendorf tube using a Reicht tissue lyser (22 frequency/seconds for 3 minutes) and a metal ball. One volume of 0.1M KCl was added and the mixture shaken for 10 minutes. The lower non-polar phase was collected after centrifuging the mixture for 5 minutes at 3000 rpm. The remaining upper (aqueous) phase was washed with 2 volumes of chloroform by mixing for 10 minutes. The second non-polar phase was also collected and pooled with the first. The solvent was evaporated from the lipids in the extract under nitrogen flow and the total dried lipid was dissolved in a known volume of chloroform.

To measure the amount of lipid in the extracted material, a known amount of 17:0-TAG was added as internal standard and the lipids from the known amount of seeds incubated in 1 N methanolic-HCl (Supelco) for 2 hours at 80° C. FAME thus made were extracted in hexane and analysed by GC. Individual FAMEs were quantified on the basis of the amount of 17:0 TAG-FAME. Individual FAMEs weights, after subtraction of weights of the esterified methyl groups from FAME, were converted into moles by dividing by molecular weights of individual FAMEs. Total moles of all FAMEs were divided by three to calculate moles of TAG and therefore glycerol. Then, moles of TAG were converted in to weight of TAG. Finally, the percentage oil content on a seed weight basis was calculated using seed weights, assuming that all of the extracted lipid is TAG or equivalent to TAG for the purpose of calculating oil content. This method was based on Li et al., (2006). Seeds other than *Camelina* or canola seeds that are of a similar size can also be analysed by this method.

Canola and other seed oil content can also be measured by nuclear magnetic resonance techniques (Rossell and Pritchard, 1991), for example, by a pulsed wave NMS 100 Minispec (Bruker Pty Ltd Scientific Instruments, Germany), or by near infrared reflectance spectroscopy such as using a NIRSystems Model 5000 monochromator. The NMR method can simultaneously measure moisture content. Moisture content can also be measured on a sample from a batch of seeds by drying the seeds in the sample for 18 hours at about 100° C., according to Li et al., (2006).

Where fatty acid composition is to be determined for the oil in canola seed, the direct methylation method used for *Arabidopsis* seed (above) can be used, modified with the addition of cracking of the canola seedcoat. This method extracts sufficient oil from the seed to allow fatty acid composition analysis.

Analysis of Lipids from Leaf Lysate Assays

Lipids from the lysate assays were extracted using chloroform:methanol:0.1 M KCl (2:1:1) and recovered. The different lipid classes in the samples were separated on Silica gel 60 thin layer chromatography (TLC) plates (MERCK, Dermstadt, Germany) impregnated with 10% boric acid. The solvent system used to fractionate TAG from the lipid extract consisted of chloroform/acetone (90/10 v/v). Individual lipid classes were visualized by exposing the plates to iodine vapour and identified by running parallel authentic standards on the same TLC plate. The plates were exposed to phosphor imaging screens overnight and analysed by a Fujifilm FLA-5000 phosphorimager before liquid scintillation counting for DPM quantification.

Total Lipid Isolation and Fractionation

Tissues including leaf samples were freeze-dried, weighed (dry weight) and total lipids extracted as described by Bligh and Dyer (1959) or by using chloroform:methanol:0.1 M KCl (CMK; 2:1:1) as a solvent. Total lipids were extracted from *N. benthamiana* leaf samples, after freeze dying, by adding 900 μL of a chloroform/methanol (2/1 v/v) mixture per 1 cm diameter leaf sample. 0.8 μg DAGE was added per 0.5 mg dry leaf weight as internal standard when TLC-FID analysis was to be performed. Samples were homogenized using an IKA ultra-turrax tissue lyser after which 500 μL 0.1 M KCl was added. Samples were vortexed, centrifuged for 5 min and the lower phase was collected. The remaining upper phase was extracted a second time by adding 600 μL chloroform, vortexing and centrifuging for 5 min. The lower phase was recovered and pooled into the previous collection. Lipids were dried under a nitrogen flow and resuspended in 2 μL chloroform per mg leaf dry weight. Total lipids of *N. tabacum* leaves or leaf samples were extracted as above with some modifications. If 4 or 6 leaf discs (each approx 1 cm² surface area) were combined, 1.6 ml of CMK solvent was used, whereas if 3 or less leaf discs were combined, 1.2 ml CMK was used. Freeze dried leaf tissues were homogenized in an eppendorf tube containing a metallic ball using a Reicht tissue lyser (Qiagen) for 3 minutes at 20 frequency/sec.

Separation of Neutral Lipids Via TLC and Transmethylation

Known volumes of total leaf extracts such as, for example, 30 μL, were loaded on a TLC silica gel 60 plate (1×20 cm) (Merck KGaA, Germany). The neutral lipids were separated via TLC in an equilibrated development tank containing a hexane/DEE/acetic acid (70/30/1 v/v/v/) solvent system. The TAG bands were visualised by iodine vapour, scraped from the TLC plate, transferred to 2 mL GC vials and dried with $N_2$. 750 μL of 1N methanolic-HCl (Supelco analytical, USA) was added to each vial together with a known amount of C17:0 TAG, such as, for example, 30 μg, as internal standard for quantification.

When analysing the effect on oleic acid levels of specific gene combinations, TAG and polar lipids bands were collected from the TLC plates. Next, 15 μg of C17:0 internal standard was added to samples such as TAG samples, polar lipid samples and 20 μL of the total lipid extracts. Following drying under $N_2$, 70 μL toluene and 700 μL methanolic HCl were added.

Lipid samples for fatty acid composition analysis by GC were transmethylated by incubating the mixtures at 80° C. for 2 hours in the presence of the methanolic-HCl. After cooling samples to room temperature, the reaction was stopped by adding 350 μl $H_2O$. Fatty acyl methyl esters (FAME) were extracted from the mixture by adding 350 μl hexane, vortexing and centrifugation at 1700 rpm for 5 min. The upper hexane phase was collected and transferred into GC vials with 300 μl conical inserts. After evaporation, the samples were resuspended in 30 μl hexane. One μl was injected into the GC.

The amount of individual and total fatty acids (TFA) present in the lipid fractions was quantified by GC by determining the area under each peak and calculated by comparison with the peak area for the known amount of internal standard. TAG content in leaf was calculated as the sum of glycerol and fatty acyl moieties in the TAG fraction using a relation: % TAG by weigh=100×((41× total mol FAME/3)+ (total g FAME−(15× total mol FAME)))/g leaf dry weight, where 41 and 15 are molecular weights of glycerol moiety and methyl group, respectively.

Capillary Gas-Liquid Chromatography (GC)

FAME were analysed by GC using an Agilent Technologies 7890A GC (Palo Alto, Calif., USA) equipped with an SGE BPX70 (70% cyanopropyl polysilphenylene-siloxane) column (30 m×0.25 mm i.d., 0.25 μm film thickness), an FID, a split/splitless injector and an Agilent Technologies 7693 Series auto sampler and injector. Helium was used as the carrier gas. Samples were injected in split mode (50:1 ratio) at an oven temperature of 150° C. After injection, the oven temperature was held at 150° C. for 1 min, then raised to 210° C. at 3° C. min$^{-1}$ and finally to 240° C. at 50° C.min$^{-1}$ Peaks were quantified with Agilent Technologies ChemStation software (Rev B.04.03 (16), Palo Alto, Calif., USA) based on the response of the known amount of the external standard GLC-411 (Nucheck) and C17:0-Me internal standard.

Quantification of TAG via Iatroscan

One μL of lipid extract was loaded on one Chromarod-SII for TLC-FID Iatroscan™ (Mitsubishi Chemical Medience Corporation—Japan). The Chromarod rack was then transferred into an equilibrated developing tank containing 70 mL of a hexane/CHCl$_3$/2-propanol/formic acid (85/10.716/ 0.567/0.0567 v/v/v/v) solvent system. After 30 min of incubation, the Chromarod rack was dried for 3 min at 100° C. and immediately scanned on an Iatroscan MK-6s TLC-FID analyser (Mitsubishi Chemical Medience Corporation—Japan). Peak areas of DAGE internal standard and TAG were integrated using SIC-480II integration software (Version: 7.0-E SIC System instruments Co., LTD—Japan).

TAG quantification was carried out in two steps. First, DAGE was scanned in all samples to correct the extraction yields after which concentrated TAG samples were selected and diluted. Next, TAG was quantified in diluted samples with a second scan according to the external calibration using glyceryl trilinoleate as external standard (Sigma-Aldrich).

Quantification of TAG in Leaf Samples by GC

The peak area of individual FAME were first corrected on the basis of the peak area responses of known amounts of the same FAMEs present in a commercial standard GLC-411 (NU-CHEK PREP, Inc., USA). The corrected areas were used to calculate the mass of each FAME in the sample by comparison to the internal standard. Since oil is stored primarily in the form of TAG, the amount of oil was calculated based on the amount of FAME in each sample. Total moles of glycerol were determined by calculating the number of moles of FAMEs and dividing total moles of FAMEs by three. The amount of TAG was calculated as the sum of glycerol and fatty acyl moieties using the formula: % oil by weight=100× ((41× total mol FAME/3)+(total g FAME−(15× total mol FAME)))/g leaf dry weight, where 41 and 15 were the molecular weights of glycerol moiety and methyl group, respectively.

DGAT Assay in *Saccharomyces cerevisiae* H1246

*Saccharomyces cerevisiae* strain H1246 is completely devoid of DGAT activity and lacks TAG and sterol esters as a result of knockout mutations in four genes (DGA1, LRO1, ARE1, ARE2). The addition of free fatty acid (e.g. 1 mM $18:1^{\Delta 9}$) to H1246 growth media is toxic in the absence of DGAT activity. Growth on such media can therefore be used as an indicator or selection for the presence of DGAT activity in this yeast strain.

S cerevisiae H1246 was transformed with the pYES2 construct (negative control), a construct encoding Arabidopsis thaliana DGAT1 in pYES2, or a construct encoding Mus musculus MGAT2 in pYES2. Transformants were fed [$^{14}$C] 18:1$^{\Delta 9}$ free fatty acids.

In a separate experiment, S cerevisiae H1246 was transformed with the pYES2 construct (negative control), a construct encoding Bernadia pulchella DGAT1 in pYES2, or a construct encoding M. musculus MGAT1 in pYES2 and fed 18:1$^{\Delta 9}$ free fatty acids. S. cerevisiae S288C wild type strain transformed with pYES2 served as a positive control.

Yeast transformants were resuspended in sterile mQ water and diluted to OD600=1. Samples were further diluted in four consecutive dilutions, each at $^1$/$_{10}$. 2 μl of each dilution was spotted on each of the plates (YNBD, YNBG, YNBG+FA) together with 2 μL mQ water and 2 μL of an untransformed H1246 cell suspension (OD600=1). Plates were incubated for 6 days at 30° C. before scoring growth.

Plate Medium, 40 mL Media Per Plate

YNBD: minimal dropout medium lacking uracil and containing 2% glucose, 0.01% NP40 and 100 μL ethanol.

YNBG: minimal dropout medium lacking uracil and containing 2% galactose, 1% raffinose, 0.01% NP40 and 100 μL ethanol.

YNBG+FA: minimal dropout medium lacking uracil and containing 2% galactose, 1% raffinose, 0.01% NP40 and 1 mM C18:1$^{\Delta 9}$ dissolved in 100 μl ethanol.

Example 2

Constitutive Expression of a Monoacylglycerol Acyltransferase in plant cells

MGAT1

The enzyme activity of the monoacylglycerol acyltransferase 1 (MGAT1) encoded by the gene from M. musculus (Yen et al., 2002) and A. thaliana diacylglycerol acyltransferase (DGAT1) (Bouvier-Nave et al., 2000), used here as a comparison with MGAT1, were demonstrated in N. benthamiana leaf tissue using a transient expression system as described in Example 1.

A vector designated 355-pORE04 was made by inserting a PstI fragment containing a 35S promoter into the SfoI site of vector pORE04 after T4 DNA polymerase treatment to blunt the ends (Coutu et al., 2007). A chimeric DNA encoding the M. musculus MGAT1, codon-optimised for Brassica napus, was synthesized by Geneart and designated 0954364_MGAT_pMA. A chimeric DNA designated 35S:MGAT1 and encoding the M. musculus MGAT1 (Genbank Accession No. Q91ZV4) for expression in plant cells was made by inserting the entire coding region of 0954364_MGAT_pMA, contained within an EcoRI fragment, into 35S-pORE04 at the EcoRI site. The vector containing the 35S:MGAT1 construct was designated as pJP3184. Similarly, a chimeric DNA 35S:DGAT1 encoding the A. thaliana DGAT1 (Genbank Accession No. AAF19262) for expression in plant cells was made by inserting the entire coding region of pXZP513E, contained within a BamHI-EcoRV fragment, into 35S-pORE04 at the BamHI-EcoRV site. The vector containing the 35S:DGAT1 construct was designated pJP2078.

The chimeric vectors were introduced into A. tumefaciens strain AGL1 and cells from cultures of these infiltrated into leaf tissue of N. benthamiana plants in a 24° C. growth room. In order to allow direct comparisons between samples and to reduce inter-leaf variation, samples being compared were infiltrated on either side of the same leaf. Experiments were performed in triplicate. Following infiltration, the plants were grown for a further three days before leaf discs were taken, freeze-dried, and lipids extracted from the samples were fractionated and quantified as described in Example 1. This analysis revealed that the MGAT 1 and DGAT 1 genes were functioning to increase leaf oil levels in N. benthamiana as follows.

Leaf tissue transformed with the 35S:p19 construct only (negative control) contained an average of 4 μg free fatty acid (FFA) derived from DAG/mg dry leaf weight and 5 μg FFA derived from TAG/mg dry leaf weight. Leaf tissue transformed with the 35S:p19 and 35S:DGAT1 constructs (control for expression of DGAT1) contained an average of 4 μg FFA derived from DAG/mg dry leaf weight and 22 μg FFA derived from TAG/mg dry leaf weight. Leaf tissue transformed with the 35S:p19 and 35S:MGAT1 constructs contained an average of 8 μg FFA derived from DAG/mg dry leaf weight and 44 μg FFA derived from TAG/mg dry leaf weight. Leaf tissue transformed with the 35S:p19, 35S:DGAT1 and 35S:MGAT1 constructs did not contain DAG or TAG levels higher than those observed in the 35S:p19 and 35S:MGAT1 infiltration (FIG. 2). Also, a decrease in the level of saturates in seeds was noted after MGAT expression when compared with either the p19 control or DGAT1 samples (Table 2).

The data described above demonstrated that the MGAT1 enzyme was far more active than the DGAT1 enzyme in promoting both DAG and TAG accumulation in leaf tissue. Expression of the MGAT1 gene resulted in twice as much TAG and DAG accumulation in leaf tissue compared to when the DGAT1 was expressed. This result was highly surprising and unexpected, considering that the MGAT is an enzyme expressed in mouse intestine, a vastly different biological system than plant leaves. This study was the first demonstration of ectopic MGAT expression in a plant cell.

Leaf samples infiltrated with M. musculus MGAT1 accumulated double the DAG and TAG relative to leaf tissue infiltrated with A. thaliana DGAT1 alone. The efficiency of the production of TAG was also surprising and unexpected given that the mouse MGAT has only very low activity as a DGAT. Leaf tissue infiltrated with genes encoding both MGAT1 and DGAT1 did not accumulate significantly more TAG than the MGAT1-only leaf sample. FIG. 1 is a representation of various TAG accumulation pathways, most of which converge at DAG, a central molecule in lipid synthesis. For instance, MAG, DAG and TAG can be inter-converted via various enzyme activities including transacylation, lipase, MGAT, DGAT and PDAT. A decrease in the level of saturates was also noted after MGAT expression.

MGAT2

A chimeric DNA designated 35S:MGAT2 and encoding the M. musculus MGAT2 for expression in plant cells was made by inserting the entire MGAT2 coding region, contained within an EcoRI fragment, into 35S-pORE04 at the EcoRI site. The enzyme activity of the monoacylglycerol acyltransferase 2 (MGAT2) encoded by the gene from M. musculus (Yen, 2003) (Genbank Accession No. Q80W94) and A. thaliana DGAT1 (Bouvier-Nave et al., 2000), used here as a comparison with MGAT2, was also demonstrated in N. benthamiana leaf tissue using a transient expression system as described in Example 1.

Compared with controls, DGAT1 expression increased leaf TAG 5.9-fold, MGAT2 by 7.3-fold and the combination of MGAT2+DGAT1 by 9.8-fold (FIG. 3). The ability of MGAT2 alone to yield such significant increases in TAG was unexpected for a number of reasons. Firstly, the amount of substrate MAG present in leaf tissue is known to be low and large increases in TAG accumulation from this substrate would not be expected. Secondly, the addition of MGAT activity alone (i.e., addition of MGAT2 which does not have DGAT activity) would be expected to yield DAG, not TAG, especially in a leaf environment where little native DGAT activity is usually present.

Discussion

The present inventors have surprisingly demonstrated that the transgenic expression of a MGAT gene results in significant increases in lipid yield in plant cells. The present inventors understand that Tumaney et al. had isolated a DGAT with some MGAT activity and that they were not successful in attempts to clone a gene encoding a MGAT as defined herein. Tumaney et al. (2001) reported MGAT activity in peanut and isolated an enzyme responsible for this activity. However, Tumaney et al. did not publish results of tests for DGAT activity and it therefore seems that the enzyme reported was a DGAT with some MGAT activity. Indeed, previous work had failed to identify any MGAT activity in other species (Stobart et al., 1997). Furthermore, it was surprising that the enzyme isolated by Tumaney et al. was a soluble, cytosolic, enzyme rather than a membrane-bound enzyme.

Recently, researchers have identified a microsomal membrane-bound monoacylglycerol acyltransferase (MGAT) from immature peanut (*Arachis hypogaea*) seeds. The MGAT could be solubilized from microsomal membranes using a combination of a chaotropic agent and a zwitterionic detergent, and a functionally active 14S multiprotein complex was isolated and characterized. Oleosin3 (OLE3) was identified as part of the multiprotein complex, which is capable of performing bifunctional activities such as acylating monoacylglycerol (MAG) to diacylglycerol (DAG) and phospholipase A2 (PLA2; Parthibane et al., 2012).

Example 3

Biochemical Demonstration of Transgenic MGAT Activity in Leaf Extracts

Cell lysates were made from *N. benthamiana* leaf tissue that had been infiltrated with 35S:MGAT1, 35S:MGAT2 and 35S:DGAT1, as described in Example 1. Separate leaf infiltrations were performed, each in triplicate, for strains containing the 35S:p19 construct only (negative control), the 35S:MGAT2 strain together with the 35S:p19 strain, and a mixture of the 35S:MGAT2 and 35S:DGAT1 *Agrobacterium* strains with the 35S:p19 strain. The triplicate samples were harvested after three days and a purified cell lysate prepared by mechanical tissue lysis and centrifugation. The MGAT activities of the purified cell lysates were compared by feeding [$^{14}$C]MAG to the lysates as described in Example 1. The data are shown in FIG. 4.

Little MGAT activity was observed in the 35S:p19 control sample, since most of the radioactivity remained in MAG throughout the assay. In contrast, the majority of the labelled MAG in the 35S:MGAT2 sample was rapidly converted to DAG (FIG. 4, central panel), indicating strong MGAT activity expressed from the 35S:MGAT2 construct. Furthermore, a significant amount of TAG was also produced. The TAG production observed in the 35S:MGAT2 sample was likely due to native *N. benthamiana* DGAT activity, or produced by another TAG synthesis route. The amount of TAG production was greatly increased by the further addition of 35S:DGAT1 (FIG. 4, right hand panel), indicating that the MGAT2 enzyme produced DAG which was accessible for conversion to TAG by DGAT1 in plant vegetative tissues.

Example 4

Biochemical Demonstration of the Production of MGAT-Accessible MAG in Leaf Extracts In the in vitro assays described in Example 3 using leaf lysates, the substrates (sn-2 MAG and oleoyl-CoA) were exogenously supplied, whereas in vivo MGAT activity in intact plant tissues would require the native presence of these substrates. The presence of low levels of MAG is various plant tissues has been reported previously (Hirayama and Hujii, 1965; Panekina et al., 1978; Lakshminarayana et al., 1984; Perry & Harwood, 1993). To test whether the MGAT2 could access MAG produced by native plant pathways, the above experiment was repeated but this time feeding [$^{14}$C]G-3-P to the lysates. The resultant data are shown schematically in FIG. 5.

The production of labelled MAG was observed in all samples, indicating the de novo production of MAG from the G-3-P in plant leaf lysates. Labelled DAG and TAG products were also observed in all samples although these were relatively low in the 35S:p19 control sample, indicating that the production of these neutral lipids by the endogenous Kennedy pathway was relatively low in this sample. In contrast, the majority of the label in the MGAT2 and MGAT2+DGAT1 samples appeared in the DAG and TAG pools, indicating that the exogenously added MGAT catalysed conversion of the MAG that had been produced from the labelled G-3-P by a native plant pathway.

Examples 2 to 4 demonstrate several key points: 1) Leaf tissue can synthesise MAG from G-3-P such that the MAG is accessible to an exogenous MGAT expressed in the leaf tissue; 2) Even an MGAT which is derived from mammalian intestine can function in plant tissues, not known to possess an endogenous MGAT, requiring a successful interaction with other plant factors involved in lipid synthesis; 3) DAG produced by the exogenous MGAT activity is accessible to a plant DGAT, or an exogenous DGAT, to produce TAG; and 4) the expression of an exogenous MGAT can yield greatly increased TAG levels in plant tissues, levels which are at least as great as that yielded by exogenous *A. thaliana* DGAT1 expression.

Example 5

Expression of DGAT1, MGAT1 and MGAT2 in Yeast

Chimeric yeast expression vectors were constructed by inserting genes encoding the *A. thaliana* DGAT1, *M. musculus* MGAT1 and *M. musculus* MGAT2 into the pYES2 vector to yield pYES2:DGAT1, pYES2:MGAT1 and pYES2:MGAT2. These constructs were transformed in *Saccharomyces cerevisiae* strain H1246 which is completely devoid of DGAT activity and lacks TAG and sterol esters as a result of knockout mutations in four genes (DGA1, LRO1, ARE1, ARE2). Yeast strain H1246 is capable of synthesizing DAG from exogenously added fatty acids, but is unable to convert the DAG to TAG because of the knockout mutations. The transformed yeast cultures were fed [$^{14}$C]18:1$^{\Delta 9}$ before total lipids were extracted and fractionated by TLC as described in Example 1. An autoradiogram of a representative TLC plate is shown in FIG. 6.

TAG formation, indicating the presence of DGAT activity, was observed for the yeast cells containing either DGAT1 (positive control) and the mammalian MGAT1, but not in cells containing the MGAT2 encoded by the native *M. musculus* coding region. It was concluded that MGAT1 from mouse also had DGAT activity in yeast cells, and therefore functioned as a dual function MGAT/DGAT enzyme, whereas MGAT2 did not have detectable DGAT activity and was therefore solely an MGAT. A construct which included an MGAT2 coding region which was codon optimization for expression in yeast exhibited MGAT activity (production of DAG) when tested in vitro using yeast microsomes and labelled MAG substrate, whereas a similar construct which was codon-optimised for expression in *B. napus* did not show DAG production in the yeast microsomes. This experiment

Example 6

Expression of a Monoacylglycerol Acyltransferase in Plants, Seeds and Fungi

Expression of MGAT1 in *Arabidopsis thaliana* Seeds

A gene encoding *M. musculus* MGAT1 and under the control of a seed-specific promoter (FP1, a truncated *Brassica napus* napin promoter) was used to generate stably transformed *A. thaliana* plants and progeny seeds. The vector designated pJP3174 was made by inserting a SalI fragment containing an EcoRI site flanked by the FP1 promoter and *Glycine max* lectin polyadenylation signal into the SalI-XhoI site of vector pCW141. The pCW141 vector also contained an FP1-driven, intron-interrupted, seed-secreted GFP as a screenable marker gene. The chimeric gene designated FP1:MGAT1-GFP was made by inserting the entire coding region of the construct 0954364_MGAT_pMA, contained within an EcoRI fragment, into pJP3174 at the EcoRI site, generating pJP3179. This chimeric vector was introduced into *A. tumefaciens* strain AGL1 and cells from culture of the transformed *Agrobacterium* used to treat *A. thaliana* (ecotype Columbia) plants using the floral dip method for transformation (Clough and Bent, 1998). After maturation, the seeds from the treated plants were viewed under a Leica MZFLIII dissection microscope and ebq 100 mercury lamp. Fifteen transgenic seeds (strongly GFP positive) and fifteen non-transgenic (GFP negative) seeds were isolated and each set pooled. The GFP positive and GFP negative pools were analysed for total fatty acid content as described in Example 1. This analysis provided the average fatty acid content and composition for seeds transformed with the MGAT construct, but in a population which may have contained both hemizygous and homozygous transformed seeds.

This analysis revealed that the MGAT1 gene was functioning to increase seed oil levels in *A. thaliana* seed with the fifteen non-transgenic seeds (control, the same as wild-type) containing an average of 69.4 µg total fatty acids while the fifteen transgenic seeds transformed with the GFP gene, and therefore likely to contain the FP1:MGAT1 genetic construct, contained an average of 71.9 µg total fatty acids. This was an increase of 3.5% in the oil content relative to the control (wild-type). The analysis also revealed that the MGAT gene was functioning to enrich polyunsaturated fatty acids in the seed, as seen from the fatty acid composition of the total extracted lipid obtained from the seeds. In particular, the amount of ALA present as a percentage of the total fatty acid extracted from the seeds increasing from 16.0 to 19.6%. Similarly, the percentage of the fatty acid 20:2n6 increased from 1.25% to 1.90% and the fatty acid 20:3n3 increased from 0.26% to 0.51% (Table 2).

TABLE 2

Effect of MGAT expression on seed fatty acid composition.
FA profile (% of TFA)

| Sample | 16:00 | 16:01 | 16:3w3 | C18:0 | C18:1d9 | C18:1d11 | C18:2 | C18:3 |
|---|---|---|---|---|---|---|---|---|
| Control | 7.41 | 0.36 | 0.12 | 3.00 | 15.26 | 1.98 | 30.93 | 15.98 |
| MGAT1 | 7.11 | 0.32 | 0.11 | 2.95 | 13.86 | 1.51 | 28.87 | 19.59 |

| Sample | C20:0 | 20:1d11 | 20:1iso | 20:2n6 | 20:3n3 | C22:0 | C22:1 | C24:0 | 24:1d15 | Total |
|---|---|---|---|---|---|---|---|---|---|---|
| Control | 1.86 | 17.95 | 1.74 | 1.25 | 0.26 | 0.57 | 0.98 | 0.20 | 0.17 | 100.00 |
| MGAT1 | 1.90 | 17.22 | 1.71 | 1.90 | 0.51 | 0.57 | 1.52 | 0.19 | 0.17 | 100.00 |

A further experiment was performed where the FP1:MGAT1-GFP chimeric DNA was modified to remove the GFP gene. This genetic construct, designated FP1:MGAT1, was transformed into an *A. thaliana* line which was mutant for FAD2. The total fatty acid content of the $T_2$ seed from antibiotic resistant $T_1$ plants, as well as parental lines grown alongside these plants, was determined according to Example 1. The data is shown in Table 3. The average total fatty acids of the seed from the control lines was 347.9 µg/100 seeds whereas the average of the transgenic seeds was 381.0 µg/100 seeds. When the data for the control line C6 was excluded for determining the average, the average for the controls was 370 µg/100 seeds. The oil content in the transgenic seeds represented an increase of about 3% in relative terms compared to the oil content in the untransformed seeds.

TABLE 3

*Arabidopsis thaliana* $T_2$ FP1:MGAT1 transgenic and parental control
seed fatty acid profiles and total fatty acid quantification.

| Sample | C16:0 | C16:1 | C18:0 | C18:1 | C18:1d11 | C18:2 | C18:3 | C20:0 | 20:1d11 | C22:0 | C24:0 | 24:1d15 | µg FA/100 seeds |
|---|---|---|---|---|---|---|---|---|---|---|---|---|---|
| C7 | 6.2 | 0.5 | 2.5 | 81.3 | 4.2 | 0.6 | 2.7 | 0.7 | 0.7 | 0.3 | 0.2 | 0.1 | 442.5 |
| C4 | 6.3 | 0.4 | 2.4 | 81.7 | 3.9 | 0.5 | 2.5 | 0.9 | 0.6 | 0.4 | 0.2 | 0.1 | 403.8 |

TABLE 3-continued

*Arabidopsis thaliana* T₂ FP1:MGAT1 transgenic and parental control seed fatty acid profiles and total fatty acid quantification.

| Sample | C16:0 | C16:1 | C18:0 | C18:1 | C18:1d11 | C18:2 | C18:3 | C20:0 | 20:1d11 | C22:0 | C24:0 | 24:1d15 | μg FA/100 seeds |
|---|---|---|---|---|---|---|---|---|---|---|---|---|---|
| C8  | 6.4 | 0.5 | 2.6 | 81.1 | 4.1 | 0.6 | 2.6 | 0.8 | 0.6 | 0.4 | 0.2 | 0.1 | 403.2 |
| C2  | 6.2 | 0.5 | 2.4 | 81.4 | 4.1 | 0.6 | 2.7 | 0.8 | 0.6 | 0.4 | 0.2 | 0.1 | 377.0 |
| C1  | 6.4 | 0.5 | 2.4 | 80.6 | 4.1 | 0.7 | 3.3 | 0.8 | 0.6 | 0.4 | 0.2 | 0.1 | 344.8 |
| C3  | 6.4 | 0.5 | 2.6 | 80.0 | 4.1 | 0.6 | 3.5 | 0.8 | 0.6 | 0.4 | 0.2 | 0.2 | 314.3 |
| C5  | 6.3 | 0.5 | 2.6 | 80.7 | 4.4 | 0.6 | 2.4 | 0.7 | 0.6 | 0.9 | 0.2 | 0.1 | 310.6 |
| C6  | 6.7 | 0.7 | 2.7 | 77.2 | 5.0 | 0.8 | 4.3 | 0.9 | 0.7 | 0.4 | 0.3 | 0.2 | 186.8 |
| M23 | 5.9 | 0.4 | 2.0 | 81.4 | 5.0 | 0.8 | 2.4 | 0.7 | 0.7 | 0.5 | 0.2 | 0.2 | 455.7 |
| M10 | 6.0 | 0.4 | 2.4 | 82.3 | 4.2 | 0.7 | 2.2 | 0.7 | 0.6 | 0.3 | 0.2 | 0.1 | 437.7 |
| M22 | 5.9 | 0.4 | 2.2 | 81.4 | 4.8 | 0.8 | 2.4 | 0.7 | 0.6 | 0.4 | 0.2 | 0.2 | 425.0 |
| M25 | 6.0 | 0.4 | 2.2 | 81.7 | 4.6 | 0.7 | 2.4 | 0.8 | 0.6 | 0.3 | 0.2 | 0.1 | 406.7 |
| M8  | 6.0 | 0.4 | 2.2 | 81.6 | 4.5 | 0.8 | 2.5 | 0.7 | 0.6 | 0.3 | 0.2 | 0.2 | 404.5 |
| M14 | 5.7 | 0.4 | 2.1 | 81.8 | 4.6 | 0.8 | 2.5 | 0.7 | 0.6 | 0.3 | 0.2 | 0.2 | 396.4 |
| M26 | 6.2 | 0.4 | 2.2 | 81.8 | 4.4 | 0.8 | 2.2 | 0.7 | 0.6 | 0.4 | 0.2 | 0.1 | 393.0 |
| M6  | 5.9 | 0.4 | 2.2 | 81.8 | 4.5 | 0.8 | 2.4 | 0.7 | 0.6 | 0.3 | 0.2 | 0.2 | 392.9 |
| M5  | 5.9 | 0.5 | 2.2 | 80.9 | 4.8 | 0.9 | 2.6 | 0.7 | 0.7 | 0.5 | 0.2 | 0.2 | 389.7 |
| M17 | 6.3 | 0.4 | 2.3 | 75.1 | 4.7 | 4.8 | 4.4 | 0.7 | 0.6 | 0.3 | 0.2 | 0.1 | 388.4 |
| M9  | 6.1 | 0.4 | 2.3 | 81.8 | 4.4 | 0.7 | 2.4 | 0.7 | 0.6 | 0.3 | 0.2 | 0.1 | 388.2 |
| M20 | 6.2 | 0.4 | 2.2 | 81.5 | 4.7 | 0.7 | 2.3 | 0.7 | 0.6 | 0.3 | 0.2 | 0.1 | 379.1 |
| M12 | 6.2 | 0.4 | 2.2 | 81.6 | 4.4 | 1.0 | 2.2 | 0.7 | 0.6 | 0.3 | 0.2 | 0.1 | 374.7 |
| M18 | 6.2 | 0.4 | 2.4 | 81.3 | 4.7 | 0.7 | 2.3 | 0.8 | 0.5 | 0.3 | 0.2 | 0.1 | 369.1 |
| M24 | 6.1 | 0.4 | 2.2 | 81.6 | 4.6 | 0.7 | 2.3 | 0.9 | 0.6 | 0.3 | 0.2 | 0.1 | 361.7 |
| M7  | 5.9 | 0.4 | 2.3 | 81.9 | 4.5 | 0.7 | 2.3 | 0.7 | 0.6 | 0.3 | 0.2 | 0.1 | 359.4 |
| M4  | 6.2 | 0.4 | 2.4 | 81.3 | 4.4 | 0.7 | 2.5 | 0.8 | 0.5 | 0.3 | 0.2 | 0.2 | 352.3 |
| M13 | 6.1 | 0.4 | 2.3 | 81.4 | 4.5 | 0.8 | 2.4 | 0.7 | 0.6 | 0.3 | 0.2 | 0.1 | 352.0 |
| M16 | 6.1 | 0.4 | 2.2 | 81.8 | 4.4 | 0.7 | 2.4 | 0.7 | 0.6 | 0.3 | 0.2 | 0.2 | 340.5 |
| M19 | 6.1 | 0.4 | 2.3 | 80.9 | 4.9 | 0.8 | 2.7 | 0.7 | 0.5 | 0.3 | 0.2 | 0.1 | 318.6 |
| M3  | 6.0 | 0.5 | 2.3 | 81.1 | 4.7 | 0.9 | 2.7 | 0.7 | 0.6 | 0.3 | 0.2 | 0.2 | 316.6 |

The coding region of the mouse MGAT2 gene, codon-optimised for expression in plant cells, was substituted for the MGAT1 coding region in the constructs mentioned above, and introduced into *Arabidopsis*. Thirty plants of each transgenic line (T1 and T2 plants, giving rise to T2- and T3-generation seeds) were grown in the greenhouse in a randomly arranged distribution and compared to control plants. Seeds from the transgenic plants were increased in their oil content relative to the control seeds (FIG. 7). The average TAG percentage of the T3 transgenic seeds represented a relative increase of about 8% compared to the TAG percentage in the untransformed seeds (Table 4). A significant increase was observed in the level of polyunsaturated fatty acids in the TAG of the transgenic seeds, in particular of ALA, and a decrease in saturated fatty acid levels such as palmitic and stearic acids. Moreover, the increased TAG levels and altered fatty acid composition was more pronounced in the T3 generation than in the T2 seeds, presumably due to the homozygous state of the transgene in the T3 seeds.

TABLE 4

TAG levels and fatty acid composition in TAG extracted from *Arabidopsis thaliana* T2 and T3 seeds expressing MGAT2 compared to untransformed control seed.

| | C14:0 | C16:0 | C16:1 | C18:0 | C18:1d9 | C18:1d11 | C18:2 | C18:3 | C20:0 | C20:1 | 20:1iso | 20:2n6 | C22:1 | C24:0 | 24:1 | % TAG by Seed weight |
|---|---|---|---|---|---|---|---|---|---|---|---|---|---|---|---|---|
| Control  | 0.1 | 8.1 | 0.3 | 3.3 | 13.2 | 1.8 | 28.4 | 20.0 | 2.2 | 17.2 | 1.9 | 1.8 | 1.2 | 0.3 | 0.2 | 32.4 |
| T2 seeds | 0.1 | 7.2 | 0.2 | 2.8 | 13.0 | 1.3 | 27.9 | 24.3 | 1.6 | 14.8 | 3.1 | 1.8 | 1.2 | 0.3 | 0.2 | 37.9 |
| T3 seeds | 0.1 | 6.1 | 0.2 | 2.5 | 12.3 | 1.2 | 28.4 | 26.7 | 1.8 | 15.3 | 1.5 | 1.9 | 1.5 | 0.4 | 0.2 | 40.2 |

Expression of MGAT1 in *Brassica napus* Seeds

The vector FP1:MGAT1 used for the expression of *M. musculus* MGAT1 in *Arabidopsis thaliana* seeds was used to generate transformed *B. napus* plants. The vector was introduced into *A. tumefaciens* strain AGL1 via standard electroporation procedures. Cultures were grown overnight at 28° C. in LB medium with agitation at 150 rpm. The bacterial cells were collected by centrifugation at 4000 rpm for 5 minutes, washed with Winans' AB (Winans, 1988) and re-suspended in 10 mL of Winans' AB medium (pH 5.2) and grown with kanamycin (50 mg/L) and rifampicin (25 mg/L) overnight with the addition of 100 μM acetosyringone. Two hours before infection of the *Brassica* cells, spermidine (120 mg/L) was added and the final density of the bacteria adjusted to an OD 600 nm of 0.3-0.4 with fresh AB media, Freshly isolated cotyledonary petioles from 8-day old *B. napus* seedlings grown on 1/2 MS (Murashige-Skoog, 1962) or hypocotyl segments preconditioned by 3-4 days on MS media with 1 mg/L thidiazuron (TDZ)+0.1 mg/L alpha-naphthaleneacetic acid (NAA) were infected with 10 mL *Agrobacterium* cultures for 5 minutes. Explants (cotyledonary petiole and hypocotyl) infected with *Agrobacterium* were then blotted on sterile filter paper to remove the excess *Agrobacterium* and transferred to co-cultivation media (MS media with 1 mg/L TDZ+0.1 mg/L NAA+100 µM acetosyringone) supplemented with or without different antioxidants (L-cysteine 50 mg/L and ascorbic 15 mg/L). All the plates were sealed with paraffin) and incubated in the dark at 23-24° C. for 48 hours.

The co-cultivated explants (cotyledonary petiole and hypocotyl) were then washed with sterile distilled water+500 mg/L cefotaxime+50 mg/L timentin for 10 minutes, rinsed in sterile distilled water for 10 minutes, blotted dry on sterile filter paper, transferred to pre-selection media (MS+1 mg/L TDZ+0.1 mg/L NAA+20 mg/L adenine sulphate (ADS)+1.5 mg/L AgNO$_3$+250 mg/L cefotaxime and 50 mg/L, timentin) and cultured for five days at 24° C. with a 16 hour/8 hour photoperiod. They were then transferred to selection media (MS+1 mg/L TDZ+0.1 mg/L NAA+20 mg/L ADS+1.5 mg/L AgNO$_3$+250 mg/L cefotaxime and 50 mg/L timentin) with 1.5 mg/L glufosinate ammonium and cultured for 4 weeks at 24° C. with 16 hour/8 hour photoperiod with a biweekly subculture onto the same media. Explants with green callus were transferred to shoot initiation media (MS+1 mg/L kinetin+20 mg/L ADS+1.5 mg/L AgNO$_3$+250 mg/L cefotaxime+50 mg/L timentin+1.5 mg/L glufosinate ammonium) and cultured for another 2-3 weeks. Shoots emerging form the resistant explants were transferred to shoot elongation media (MS media with 0.1 mg/L gibberelic acid+20 mg/L ADS+1.5 mg/L AgNO$_3$+250 mg/L ceftoxime+1.5 mg/L glufosinate ammonium and cultured for another two weeks. Healthy shoots 2-3 cm long were selected and transferred to rooting media (1/2 MS with 1 mg/L NAA+mg/L ADS+1.5 mg/L AgNO$_3$+250 mg/L cefotaxime) and cultured for 2-3 weeks. Well established shoots with roots were transferred to pots (seedling raising mix) and grown in a growth cabinet for two weeks and subsequently transferred to glasshouse. Sixteen individual transformants in the cultivar Oscar were confirmed to be transgenic for the FP1:MGAT1 construct and grew normally under glasshouse conditions. Plant growth appeared normal and the plants were fertile, flowering and setting seed normally. The plants were grown to maturity and seeds obtained from transformed plants were harvested. Seeds from some of the transformed plants were analysed for seed oil content and fatty acid composition. Data from these preliminary analyses showed variability in the oil content and fatty acid composition, probably due to the plants being grown at different times and under different environmental conditions. To reduce variability, T1 plants which express MGAT1 are produced and grown under the same conditions as control (wild-type, cultivar Oscar) plants of the same genotype, and the oil content compared.

Expression of MGAT1 in *Gossypium hirsutum* Seeds

The same seed-specific chimeric gene used for the expression of *M. musculus* MGAT1 in *Arabidopsis thaliana* seeds was used to generate transformed *Gossypium hirsutum* plants. The vector designated FP1:MGAT1 was introduced into *A. tumefaciens* strain AGL1 via standard electroporation procedures and cells from the *Agrobacterium* culture used to introduce the chimeric DNAs into cells of *Gossypium hirsutum*, variety Coker315. Cotyledons excised from 10-day old cotton seedlings were used as explants and infected and co-cultivated with *A. tumefaciens* for a period of two days. This was followed by a six-week selection on MS medium (Murashige and Skoog, 1962) containing 0.1 mg/L 2,4-D, 0.1 mg/L kinetin, 50 mg/L kanamycin sulphate, and 25 mg/L cefotaxime. Healthy calli derived from the cotyledon explants were transferred to MS medium containing 5 mg/L 6-(γ,γ-dimethylallylamino)-purine (2ip), 0.1 mg/L naphthalene acetic acid (NAA), 25 mg/L kanamycin, and 250 mg/L cefotaxime for a second period of six weeks at 28° C. Somatic embryos that formed after about six to ten weeks of incubation were germinated and maintained on the same medium, but without added phytohormone or antibiotics. Plantlets developed from the somatic embryos were transferred to soil and maintained in a glasshouse once leaves and roots were developed, with 28° C./20° C. (day/night) growth temperature. Ten independent primary transgenic plants (T0) containing the FP1-MGAT1 construct were grown in the glasshouse, flowered and produced bolls containing seeds. The seeds were harvested on maturity. To enhance the reliability of the oil content analysis, 5 plants were established from each of the 10 primary transgenic plants and the mature T2 seeds are subjected to the analysis of oil content. The seed-specific expression of MGAT1 increases oil content and increases the percentage of polyunsaturated fatty acids in the cotton seedoil.

Expression of a MGAT1 and MGAT2 Genes in *N. benthamiana* Plants after Stable Transformation

*N. benthamiana* was stably transformed with the 35S:MGAT1 construct described in Example 2. 35S:MGAT1 was introduced into *A. tumefaciens* strain AGL1 via standard electroporation procedure. The transformed cells were grown on solid LB media supplemented with kanamycin (50 mg/L) and rifampicin (25 mg/L) and incubated at 28° C. for two days. A single colony was used to initiate fresh culture. Following 48 hours vigorous culture, the cells were collected by centrifugation at 2,000×g and the supernatant was removed. The cells were resuspended in fresh solution containing 50% LB and 50% MS medium at the density of OD$_{600}$=0.5.

Leaf samples of *N. benthamiana* grown in vitro were excised and cut into square sections around 0.5-1 cm$^2$ in size with a sharp scalpel while immersed in the *A. tumefaciens* solution. The wounded *N. benthamiana* leaf pieces submerged in *A. tumefaciens* were allowed to stand at room temperature for 10 minutes prior to being blotted dry on a sterile filter paper and transferred onto MS plates without supplement. Following a co-cultivation period of two days at 24° C., the explants were washed three times with sterile, liquid MS medium, then blotted dry with sterile filter paper and placed on the selective MS agar supplemented with 1.0 mg/L benzylaminopurine (BAP), 0.25 mg/L indoleacetic acid (IAA), 50 mg/L kanamycin and 250 mg/L cefotaxime. The plates were incubated at 24° C. for two weeks to allow for shoot development from the transformed *N. benthamiana* leaf pieces.

To establish rooted transgenic plants in vitro, healthy green shoots were cut off and transferred into 200 mL tissue culture pots containing MS agar medium supplemented with 25 mg/L IAA, 50 mg/L kanamycin and 250 mg/L cefotaxime. Sufficiently large leaf discs were taken from transgenic shoots and freeze-dried for TAG fractionation and quantification analysis as described in Example 1 (Table 5). The best 35S:MGAT1 *N. benthamiana* plant had a TAG content of 204.85 µg/100 mg dry weight leaf tissue compared with an average TAG content of 85.02 µg/100 mg dry weight leaf tissue in the control lines, representing an increase in TAG content of 241%.

*N. benthamiana* was also stably transformed with the 35S:MGAT2 construct described in Example 2 and a control binary vector pORE4 (Table 6). The best 35S:MGAT2 *N. benthamiana* plant had a TAG content of 79.0 µg/100 mg dry weight leaf tissue compared with a TAG content of 9.5 µg/100 mg dry weight leaf tissue in the control line at the same developmental stage, representing an increase in TAG content of 731%. The fatty acid profile of the TAG fractions was also altered with significantly reduced levels of the saturated fatty acids 16:0 and 18:0, and increased levels of the polyunsaturated fatty acids, particularly 18:3ω3 (ALA) (Table 6). The fatty acid profile of the polar lipids from the same leaf samples were not significantly affected, indicating that the changes in the fatty acid composition of the non-polar lipids was real. The control plants in this experiment were smaller and different physiologically than in the previous experiment with the 35S:MGAT1 construct, and this may have explained the different oil contents of the control plants from one experiment to the other. Experiments to directly compare the 35S:MGAT1 and 35:MGAT2 constructs with control plants are performed using plants of the same size and physiology.

A new set of constitutive binary expression vectors was made using a 35S promoter with duplicated enhancer region (e35S). 35S:MGAT1#2 (pJP3346), 35S:MGAT2#2 (pJP3347) and 35S:DGAT1#2 (pJP3352) were made by first cloning the e35S promoter, contained within a BamHI-EcoRI fragment, into pORE04 at the BamHI-EcoRI sites to yield pJP3343. pJP3346 and pJP3347 were then produced by cloning the MGAT1 and MGAT2 genes, respectively, into the EcoRI site of pJP3343. pJP3352 was produced by cloning the *A. thaliana* DGAT1, contained within a XhoI-AsiSI site, into the XhoI-AsiSI sites of pJP3343.

pJP3346, pJP3347 and pJP3352 in *Agrobacterium* strain AGL1 were used to transform *N. benthamiana* as described above. Fourteen confirmed transgenic plants were recovered for pJP3346 and 22 for pJP3347. A number of kanamycin resistant, transformed shoots have been generated with pJP3352. Expression analysis of the transgenes was performed on the plants transformed with MGAT1 or MGAT2. Plants with high levels of expression were selected. Expression analysis on plants transformed with the *A. thaliana* DGAT1 is performed. The plants grow normally and are grown to maturity. Seed is harvested when mature. Seed from high-expressing progeny are sown directly onto soil for lipid analysis of the T2 segregating population, which includes both homozygous and heterozygous plants. Oil content of leaves of plants expressing high levels of either MGAT1 or MGAT2 is significantly increased compared to plants transformed with *A. thaliana* DGAT1 or control plants. MGAT2 transgenic plants showed a significant increase in the unsaturated fatty acid 18:1 and 1% relative increase in total fatty acid content compared to the null events (Table 7).

pJP3346, pJP3347 and a control vector in AGL1 were also used to transform *A. thaliana* as described above. Twenty-five confirmed transgenic T2 plants comprising the T-DNA from pJP3346 and 43 transgenic plants for pJP3347 were identified. Expression analysis was performed on the transgenic plants. Seeds from high-expressing progeny were harvested and sown directly onto soil. Lipid analysis including oil content of the leaves from T2 and T3 progeny was performed, including from segregants lacking the transgenes. The highest levels of TAG were obtained in plants that are homozygous for the MGAT transgenes.

TABLE 5

Fatty acid profile and quantification of TAG in *Nicotiana benthamiana* leaf tissue stably transformed with the 35S:MGAT1 construct. 'M' samples are 35S:MGAT1 whilst 'C' samples are parental control plants.

| Sample | C16:0 | 16:3w3 | C18:0 | C18:1 | C18:1d11 | C18:2 | C18:3 | C20:0 | 20:3n3 | C22:0 | C24:0 | µg/100 mg DW |
|---|---|---|---|---|---|---|---|---|---|---|---|---|
| M1 | 38.7 | 0.7 | 5.1 | 8.5 | 0.4 | 7.0 | 34.4 | 1.1 | 0.3 | 0.2 | 0.4 | 204.85 |
| M8 | 33.2 | 0.8 | 4.4 | 8.1 | 0.3 | 6.5 | 42.8 | 0.9 | 0.2 | 0.2 | 0.2 | 184.20 |
| M3 | 41.1 | 0.6 | 5.3 | 10.4 | 0.4 | 5.5 | 31.8 | 1.0 | 0.4 | 0.2 | 0.2 | 133.62 |
| M2 | 42.5 | 0.5 | 5.2 | 7.4 | 0.0 | 4.8 | 34.4 | 1.0 | 0.2 | 0.3 | 0.2 | 133.57 |
| M7 | 35.2 | 0.6 | 4.5 | 8.6 | 0.0 | 4.9 | 41.7 | 1.1 | 0.3 | 0.3 | 0.2 | 128.49 |
| M5 | 49.1 | 0.6 | 6.4 | 9.0 | 0.4 | 3.7 | 16.9 | 1.1 | 0.0 | 0.5 | 0.7 | 107.39 |
| M4 | 41.9 | 0.4 | 6.0 | 9.6 | 0.0 | 4.2 | 33.0 | 1.1 | 0.2 | 0.4 | 0.2 | 93.71 |
| M6 | 41.4 | 0.4 | 5.8 | 8.2 | 0.0 | 4.3 | 34.6 | 1.1 | 0.2 | 0.3 | 0.2 | 88.38 |
| C1 | 40.2 | 0.4 | 6.1 | 8.3 | 0.0 | 7.8 | 31.9 | 1.3 | 0.2 | 0.4 | 0.3 | 81.53 |
| C2 | 39.9 | 0.6 | 5.5 | 7.1 | 0.0 | 6.9 | 35.4 | 1.1 | 0.3 | 0.4 | 0.3 | 88.52 |

TABLE 6

Fatty acid profile and quantification of TAG in *Nicotiana benthamiana* leaf tissue stably transformed with the 35S:MGAT2 construct. 'M' samples are 35S:MGAT2 whilst 'C' samples are parental control plants. Two leaves from each plant were taken and analysed separately.

| Sample | | C16:0 | 16:1d7 | 16:1d13t | C16:1 | 16:3n3 | C18:0 | C18:1 | C18:1d11 | C18:2 | C18:3n | C20:0 | µg/100 mg DW |
|---|---|---|---|---|---|---|---|---|---|---|---|---|---|
| C, leaf 1 | TAG | 34.0 | 2.7 | 0.8 | 0.0 | 0.0 | 17.3 | 6.6 | 0.0 | 15.9 | 18.7 | 0.0 | 12.9 |
| C, leaf 2 | TAG | 35.0 | 1.8 | 0.0 | 0.0 | 1.3 | 25.0 | 3.0 | 0.0 | 13.0 | 17.6 | 1.4 | 6.1 |
| M, leaf 1 | TAG | 14.6 | 0.4 | 1.0 | 0.4 | 7.7 | 5.9 | 4.0 | 0.4 | 16.8 | 47.0 | 0.6 | 97.1 |
| M, leaf 2 | TAG | 18.1 | 0.3 | 1.0 | 0.0 | 6.0 | 8.1 | 2.8 | 0.3 | 14.0 | 46.9 | 1.0 | 60.9 |
| C, leaf 1 | PL | 13.4 | 0.0 | 3.0 | 0.2 | 7.4 | 2.0 | 2.5 | 0.4 | 8.4 | 61.4 | 0.3 | 2439.3 |
| C, leaf 2 | PL | 10.3 | 0.0 | 2.4 | 0.2 | 9.7 | 1.4 | 2.0 | 0.3 | 9.5 | 63.3 | 0.0 | 4811.5 |
| M, leaf 1 | PL | 11.6 | 0.0 | 2.4 | 0.2 | 8.7 | 1.9 | 2.4 | 0.3 | 8.7 | 63.0 | 0.0 | 3568.8 |
| M, leaf 2 | PL | 10.7 | 0.0 | 2.4 | 0.2 | 9.5 | 1.6 | 1.9 | 0.3 | 9.2 | 63.3 | 0.0 | 3571.2 |

TABLE 7

Total fatty acid amount (TFA) and fatty acid composition in *Nicotiana benthamiana* leaf tissues stably transformed with the 35S:MGAT2 construct.

| | 16:0 | 16:1 | 16:3 | 18:0 | 18:1d9 | 18:1d11 | 18:2 | 18:3w3 | 20:0 | 20:1 | 20:1iso | 22:0 | 22:1 | 24:0 | 24:1 | TFA (ug/100 ug DW) |
|---|---|---|---|---|---|---|---|---|---|---|---|---|---|---|---|---|
| MGAT | 14.5 | 1.8 | 5.2 | 2.1 | 6.3 | 0.8 | 11.3 | 53.7 | 0.4 | 0.5 | 0.2 | 0.2 | 1.2 | 0.2 | 1.2 | 4.0 |
| Nulls | 15.1 | 2.2 | 6.0 | 2.7 | 3.9 | 0.6 | 9.6 | 56.3 | 0.4 | 0.4 | 0.1 | 0.2 | 0.7 | 0.2 | 1.1 | 3.2 |

Thirty plants of each transgenic line were grown in a random arrangement in the greenhouse with parental control plants. T2 seeds were analysed for oil content and exhibited an increase of about 2% in the oil content (total fatty acid level) compared to the total fatty acid content of parental seeds (FIG. 8).

Expression of MGAT1 in Stably Transformed *Trifolium repens* Plants

A chimeric gene encoding *M. musculus* MGAT1 was used to transform *Trifolium repens*, another dicotyledonous plant. Vectors containing the chimeric genes 35S:MGAT1 and 35S:DGAT1 were introduced into *A. tumefaciens* via a standard electroporation procedure. Both vectors also contain a 35S:BAR selectable marker gene. The transformed *Agrobacterium* cells were grown on solid LB media supplemented with kanamycin (50 mg/L) and rifampicin (25 mg/L) and incubated at 28° C. for two days. A single colony was used to initiate a fresh culture for each construct. Following 48 hours vigorous culture, the *Agrobacterium* cultures were used to treat *T. repens* (cv. Haifa) cotyledons that had been dissected from imbibed seed as described by Larkin et al. (1996). Following co-cultivation for three days the explants were exposed to 5 mg/L PPT to select transformed shoots and then transferred to rooting medium to form roots, before transfer to soil. A transformed plant containing MGAT1 was obtained. The 35S promoter is expressed constitutively in cells of the transformed plants. The oil content is increased in at least the vegetative tissues such as leaves.

Expression of MGAT in Stably Transformed *Hordeum vulgare*

A chimeric vector including *M. musculus* MGAT1 was used to produce stably transformed *Hordeum vulgare*, a monocotyledonous plant. Vectors containing the chimeric genes Ubi:MGAT1 and Ubi:DGAT1 were constructed by cloning the entire *M. musculus* MGAT1 and *A. thaliana* DGAT1 coding regions separately into pWVEC8-Ubi. Vectors containing the chimeric genes Ubi:MGAT1 and Ubi:DGAT1 were introduced into *A. tumefaciens* strain AGL1 via a standard electroporation procedure. Transformed *Agrobacterium* cells were grown on solid LB media supplemented with kanamycin (50 mg/L) and rifampicin (25 mg/L) and the plates incubated at 28° C. for two days. A single colony of each was used to initiate fresh cultures.

Following 48 hours vigorous culture, the *Agrobacterium* cultures were used to transform cells in immature embryos of barley (cv. Golden Promise) according to published methods (Tingay et al., 1997; Bartlett et al., 2008) with some modifications. Briefly, embryos between 1.5 and 2.5 mm in length were isolated from immature caryopses and the embryonic axes removed. The resulting explants were co-cultivated for 2-3 days with the transgenic *Agrobacterium* and then cultured in the dark for 4-6 weeks on media containing timentin and hygromycin to generate embryogenic callus before being moved to transition media in low light conditions for two weeks. Callus was then transferred to regeneration media to allow for the regeneration of shoots and roots before transfer to soil. Transformed plants were obtained and transferred to the greenhouse. The MGAT1 coding region was expressed constitutively under the control of the Ubi promoter in cells of the transformed plants. Transgenic plants were generated and their tissues analysed for oil content. Due to the low number of transgenic events obtained in a first transformation, no statistically significant conclusion could be drawn from the data.

The coding region of the mouse MGAT2 gene, codon optimised for expression in plant cells, is substituted for the MGAT1 in the constructs mentioned above, and introduced into *Hordeum* as described above. Vegetative tissues from the resultant transgenic plants are increased for oil content.

Expression of MGAT in Yeast Cells

A chimeric vector including *M. musculus* MGAT1 was used to transform yeast, in this example *Saccharomyces cerevisiae*, a fungal microbe suitable for production of oil by fermentation. A genetic construct Gal1:MGAT1 was made by inserting the entire coding region of a construct designated 0954364_MGAT_pMA, contained within an EcoRI fragment, into pYES2 at the EcoRI site, generating pJP3301. Similarly, a genetic construct Gal1:DGAT1, used here as a comparison and separately encoding the enzyme *A. thaliana* DGAT1 was made by inserting the entire *A. thaliana* DGAT1 coding region into pYES2. These chimeric vectors were introduced into *S. cerevisiae* strain S288C by heat shock and transformants were selected on yeast minimal medium (YMM) plates containing 2% raffinose as the sole carbon source. Clonal inoculum cultures were established in liquid YMM with 2% raffinose as the sole carbon source. Experimental cultures were inoculated from these in YMM medium containing 1% NP-40, to an initial OD600 of about 0.3. Cultures were grown at 28° C. with shaking (about 100 rpm) until OD600 was approximately 1.0. At this point, galactose was added to a final concentration of 2% (w/v). Cultures were incubated at 25° C. with shaking for a further 48 hours prior to harvesting by centrifugation. Cell pellets were washed with water before being freeze-dried for lipid class fractionation and quantification analysis as described in Example 1. The Gal promoter is expressed inducibly in the transformed yeast cells, increasing the oil content in the cells.

The coding region of the mouse MGAT2 gene, codon optimised for expression in yeast cells, is substituted for the MGAT1 in the constructs mentioned above, and introduced into yeast. The resultant transgenic cells are increased for oil content. The genes are also introduced into the oleaginous yeast, *Yarrowia lipolytica*, to increase oil content.

Expression of MGAT in Algal Cells *Chlamydomonas reinhardtii*

A chimeric vector including *M. musculus* MGAT1 is used to stably transform algal cells. The genetic constructs designated 35S:MGAT1 is made by cloning the MGAT1 coding region into a cloning vector containing a Cauliflower mosaic virus 35S promoter cassette and a paramomycin-resistance gene (aminoglycoside-O-phosphotransferase VIII) expressed by a *C. reinhardtii* RBCS2 promoter. 35S:MGAT1 is introduced separately into a logarithmic culture of 5×10$^7$ cc503, a cell-wall-deficient strain of *Chlamydomonas reinhardtii* by a modified glass bead method (Kindle, 1990). Both vectors also contain the BLE resistance gene as a selectable marker gene. Briefly, a colony of non-transformed cells on a TAP agar plate kept at about 24° C. is grown to about 5×10$^6$ cells/mL over four days, the resultant cells are pelleted at 3000 g for 3 minutes at room temperature and resuspended to produce 5×10$^7$ cells in 300 uL of TAP media. 300 uL of 0.6 mm diameter glass beads, 0.6 μg plasmid in 5 μL and 100 μL of 20% PEG MW8000 are added and the mix is vortexed at maximum speed for 30 seconds, then transferred to 10 mL of TAP and incubated for 16 hours with shaking in the dark. The cells are pelleted, resuspended in 200 μL of TAP then plated on TAP plates containing 5 mg/L zeocin and incubated in the dark for 3 weeks. Transformed colonies are subcultured to a fresh TAP+zeocin 5 mg/L plate after which they are grown up under standard media conditions with zeocin selection. After harvesting by centrifugation, the cell pellets are washed with water before being freeze-dried for lipid class fractionation and quantification analysis as described in Example 1. The 35S:MGAT1 promoter is expressed constitutively in the transformed algal cells. The oil content of the cells is significantly increased.

The coding region of the mouse MGAT2 gene, codon optimised for expression in plant cells, is substituted for the MGAT1 in the construct mentioned above, and introduced into *Chlamydomonas*. Oil content in the resultant transgenic cells is significantly increased.

Expression of MGAT in Stably Transformed *Lupinus angustifolius*

A chimeric vector including *M. musculus* MGAT1 is used to transform *Lupinus angustifolius*, a leguminous plant. Chimeric vectors 35S:MGAT1 and 35S:DGAT1 in *Agrobacterium* are used to transform *L. angustifolius* as described by Pigeaire et al. (1997). Briefly, shoot apex explants are co-cultivated with transgenic *Agrobacterium* before being thoroughly wetted with PPT solution (2 mg/ml) and transferred onto a PPT-free regeneration medium. The multiple axillary shoots developing from the shoot apices are excised onto a medium containing 20 mg/L PPT and the surviving shoots transferred onto fresh medium containing 20 mg/L PPT. Healthy shoots are then transferred to soil. The 35S promoter is expressed constitutively in cells of the transformed plants, increasing the oil content in the vegetative tissues and the seeds. A seed specific promoter is used to further increase the oil content in transgenic *Lupinus* seeds.

The coding region of the mouse MGAT2 gene, codon optimised for expression in plant cells, is substituted for the MGAT1 in the constructs mentioned above, and introduced into *Lupinus*. Seeds and vegetative tissues from the resultant transgenic plants are increased for oil content.

Expression of MGAT in Stably Transformed Cells of *Sorghum bicolor*

A chimeric vector including *M. musculus* MGAT1 is used to stably transform *Sorghum bicolor*. Ubi:MGAT1 and Ubi:DGAT1 in *A. tumefaciens* strain AGL1 are used to transform *Sorghum bicolor* as described by Gurel et al. (2009). The *Agrobacterium* is first centrifuged at 5,000 rpm at 4° C. for 5 minutes and diluted to OD550=0.4 with liquid co-culture medium. Previously isolated immature embryos are then covered completely with the *Agrobacterium* suspension for 15 minutes and then cultured, scutellum side up, on co-cultivation medium in the dark for 2 days at 24° C. The immature embryos are then transferred to callus-induction medium (CIM) with 100 mg/L carbenicillin to inhibit the growth of the *Agrobacterium* and left for 4 weeks. Tissues are then transferred to regeneration medium to shoot and root. The Ubi promoter is expressed constitutively in cells of the transformed plants, increasing the oil content in at least the vegetative tissues.

The coding region of the mouse MGAT2 gene, codon optimised for expression in plant cells, is substituted for the MGAT1 in the constructs mentioned above, and introduced into *Sorghum*. Vegetative tissues from the resultant transgenic plants are increased for oil content.

Expression of MGAT in Stably Transformed Plants of *Glycine max*

A chimeric gene encoding *M. musculus* MGAT1 is used to stably transform *Glycine max*, another legume which may be used for oil production. 35S:MGAT1 in 35 *Agrobacterium* is used to transform *G. max* as described by Zhang et al. (1999). The *Agrobacterium* is co-cultivated for three days with cotyledonary explants derived from five day old seedlings. Explants are then cultured on Gamborg's B5 medium supplemented with 1.67 mg/L BAP and 5.0 mg/L glufosinate for four weeks after which explants are subcultured to medium containing MS major and minor salts and B5 vitamins (MS/B5) supplemented with 1.0 mg/L zeatin-riboside, 0.5 mg/L GA3 and 0.1 mg/L IAA amended with 1.7 mg/L or 2.0 mg/L glufosinate. Elongated shoots are rooted on a MS/B5 rooting medium supplemented with 0.5 mg/L NAA without further glufosinate selection. The 35S promoter is expressed constitutively in cells of the transformed plants, increasing the oil content in the vegetative tissues and the seeds.

The coding region of the mouse MGAT2 gene, codon optimised for expression in plant cells, is substituted for the MGAT1 in the constructs mentioned above, and introduced into Glycine. Vegetative tissues and seeds from the resultant transgenic plants are increased for oil content.

Expression of MGAT in Stably Transformed *Zea mays*

A chimeric gene encoding *M. musculus* MGAT1 is used to stably transform *Zea mays*. The vectors comprising 35S:MGAT1 and 35S:DGAT1 are used to transform *Zea mays* as described by Gould et al. (1991). Briefly, shoot apex explants are co-cultivated with transgenic *Agrobacterium* for two days before being transferred onto a MS salt media containing kanamycin and carbenicillin. After several rounds of subculture, transformed shoots and roots spontaneously form and are transplanted to soil. The 35S promoter is expressed in cells of the transformed plants, increasing the oil content in the vegetative tissues and the seeds.

The coding region of the mouse MGAT2 gene, codon optimised for expression in plant cells, is substituted for the MGAT1 in the constructs mentioned above, and introduced into *Zea mays*. Vegetative tissues and seeds from the resultant transgenic plants are increased for oil content. Alternatively, the MGAT coding regions are expressed under the control of an endosperm specific promoter such as the zein promoter, or an embryo specific promoter obtained from a monocotyledonous plant, for increased expression and increased oil content in the seeds. A further chimeric gene encoding a GPAT with phosphatase activity, such as *A. thaliana* GPAT4 or GPAT6 is introduced into *Zea mays* in combination with the MGAT, further increasing the oil content in corn seeds.

Expression of MGAT in Stably Transformed *Elaeis guineensis* (Palm Oil)

A chimeric gene encoding *M. musculus* MGAT1 is used to stably transform *Elaeis guineensis*. Chimeric vectors designated Ubi:MGAT1 and Ubi:DGAT1 in *Agrobacterium* are used. Following 48 hours vigorous culture, the cells are used to transform *Elaeis guineensis* as described by Izawati et al.

(2009). The Ubi promoter is expressed constitutively in cells of the transformed plants, increasing the oil content in at least the fruits and seeds, and may be used to obtain oil.

The coding region of the mouse MGAT2 gene, codon optimised for expression in plant cells, is substituted for the MGAT1 in the constructs mentioned above, and introduced into *Elaeis*. Seeds from the resultant transgenic plants are increased for oil content.

Expression of MGAT in Stably Transformed *Avena sativa* (Oats)

A chimeric gene encoding *M. musculus* MGAT1 is used to stably transform *Avena sativa*, another monocotyledonous plant. Chimeric vectors designated Ubi:MGAT1 and Ubi:DGAT1, as described above and both containing a Ubi:BAR selectable marker, are used to transform *Avena sativa* as described by Zhang et al. (1999).

The coding region of the mouse MGAT2 gene, codon optimised for expression in plant cells, is substituted for the MGAT1 in the constructs mentioned above, and introduced into *Avena*. Seeds from the resultant transgenic plants are increased for oil content.

Example 7

Engineering a MGAT with DGAT Activity

An MGAT with altered DGAT activity, especially increased DGAT activity and potentially increased MGAT activity may be engineered by performing random mutagenesis, targeted mutagenesis, or saturation mutagenesis on MGAT gene(s) of interest or by subjecting different MGAT and/or DGAT genes to DNA shuffling. DGAT function can be positively screened for by using, for example, a yeast strain that has an absolute requirement for TAG-synthesis complementation when fed free fatty acids, such as strain H1246 which contains mutations in four genes (DGA1, LRO1, ARE1, ARE2). Transforming the MGAT variants in such a strain and then supplying the transformed yeast with a concentration of free fatty acids that prevents complementation by the wildtype MGAT gene will only allow the growth of variants with increased TAG-synthesis capability due to improved DGAT activity. The MGAT activity of these mutated genes can be determined by feeding labelled sn-1 or sn-2 MAG and quantifying the production of labelled DAG. Several rounds of directed evolution in combination with rational protein design would result in the production of a novel MGAT gene with similar MGAT and DGAT activities.

The gene coding for the *M. musculus* MGAT1 acyltransferase was subjected to error prone PCR using Taq DNA polymerase in the presence of 0.15 mM $MnCl_2$ to introduce random mutations. The randomized coding regions were then used as megaprimers to amplify the entire yeast expression vector using high fidelity PCR reaction conditions. Sequencing of 9099 bp of recovered, mutagenised DNA revealed a mutational frequency of about 0.8%, corresponding to 8 mutations per gene or, on average, 5.3 amino acid substitutions per polypeptide. The entire mutagenised library was transformed into *E. coli* DH5α for storage at −80° C. and plasmid preparation. The size of the MGAT1 library was estimated at 3.8356E6 clones. A copy of the MGAT1 library was transformed into the yeast strain H1246, resulting in a library size of 3E6 clones. The MGAT1 library as well as a pYES2 negative control, transformed into *S. cerevisiae* H1246, were subjected to 8 selection rounds, each consisting of (re)diluting cultures in minimal induction medium (1% raffinose+2% galactose; diluted to $OD_{600}$=0.35-0.7) in the presence of C18:1 free fatty acid at a 1 mM final concentration. Negative controls consisted of identical cultures grown simultaneously in minimal medium containing glucose (2%) and in the absence of C18:1 free fatty acid. After 8 selection rounds, an aliquot of the selected MGAT1 library was plated on minimal medium containing glucose (2%). A total of 120 colonies were grown in 240 µl minimal induction medium in 96 microtiter plates and assayed for neutral lipid yield using a Nile Red fluorescence assay as described by Siloto et al. (2009). Plasmid minipreps were prepared from 113 clones (=top 6%) that displayed the highest TAG levels.

The entire MGAT1 coding region of the selected clones is sequenced to identify the number of unique mutants and to identify the nature of the selected mutations. Unique MGAT1 mutants are retransformed into *S. cerevisiae* H1246 for in vitro MGAT and DGAT assays using labelled MAG and C18:1 substrates respectively (see Example 5). Selected MGAT1 variants are found to exhibit increased DGAT activity compared to the wild type acyltransferase, whilst MGAT activity is possibly increased as well.

MGAT1 variants displaying increased MGAT and/or DGAT activities are used as parents in a DNA shuffling reaction. The resulting library is subjected to a similar selection system as described above resulting in further improvement of general acyltransferase activity. In addition, free fatty acids other than C18:1 are added to the growth medium to select for MGAT1 variants displaying altered acyl-donor specificities.

Example 8

Constitutive Expression of the *A. thaliana* Diacylglycerol Acyltransferase 2 in Plants Expression of the *A. thaliana* DGAT2 in yeast (Weselake et al., 2009) and insect cells (Lardizabal et al., 2001) did not demonstrate DGAT activity. Similarly, the DGAT2 was not able to complement an *A. thaliana* DGAT1 knockout (Weselake et al., 2009). The enzyme activity of the *A. thaliana* DGAT2 in leaf tissue was determined using a *N. benthamiana* transient expression system as described in Example 1. The *A. thaliana* DGAT2 (accession Q9ASU1) was obtained by genomic PCR and cloned into a binary expression vector under the control of the 35S promoter to generate 35S:DGAT2. This chimeric vector was introduced into *A. tumefaciens* strain AGL1 and cells from cultures of these infiltrated into leaf tissue of *N. benthamiana* plants in a 24° C. growth room using 35S:DGAT1 as a control. Several direct comparisons were infiltrated with the samples being compared located on either side of the same leaf. Experiments were performed in triplicate. Following infiltration the plants were grown for a further five days before leaf discs were taken and freeze-dried for lipid class fractionation and quantification analysis as described in Example 1. This analysis revealed that both DGAT1 and DGAT2 were functioning to increase leaf oil levels in *Nicotiana benthamiana* (Table 8).

Leaf tissue transformed with the 35S:p19 construct (negative control) contained an average of 25 µg TAG/100 mg dry leaf weight. Leaf tissue transformed with the 35S:p19 and 35S:DGAT1 constructs (positive control) contained an average of 241 µg TAG/100 mg dry leaf weight. Leaf tissue transformed with the 35S:p19 and 35S:DGAT2 constructs contained an average of 551 µg TAG/100 mg dry leaf weight.

The data described above demonstrates that the *A. thaliana* DGAT2 enzyme is more active than the *A. thaliana* DGAT1 enzyme in promoting TAG accumulation in leaf tissue. Expression of the DGAT2 gene resulted in 229% as much TAG accumulation in leaf tissue compared to when the TAG amount from DGAT1 over-expressed was set as relative 100% (FIG. 9).

Transiently-transformed *N. benthamiana* leaf tissues expressing P19 alone (control), or P19 with either AtDGAT1 or AtDGAT2 were also used to prepare microsomes for in vitro assays of enzyme activity. A DGAT biochemical assay was performed using microsomes corresponding to 50 μg protein and adding 10 nmole [14]C6:0-DAG and 5 nmole acyl-CoA, in 50 mM Hepes buffer, pH 7.2, containing 5 mM $MgCl_2$, and 1% BSA in a final volume of 100 μL, for each assay. The assays were conducted at 30° C. for 30 minutes. Total lipid from each assay was extracted and samples loaded on TLC plates, which were developed using a hexane:DEE:Hac solvent (70:30:1 vol:vol:vol). The amount of radioactivity in DAG and TAG spots was quantified by PhosphorImage measurement. The percentage of DAG converted to TAG was calculated for each of the microsome preparations.

Some endogenous DGAT activity was detected in the *N. benthamiana* leaves, as the P19 control assay showed low levels of TAG production. The expression of AtDGAT1 yielded increased DGAT activity relative to the P19 control when the assays were supplemented with either C18:1-CoA or C18:2-CoA, but not when supplemented with C18:3-CoA, where the levels of TAG for the P19 control and the AtDGAT1 were similar. However, in all of the microsomal assays when AtDGAT2 was expressed in the leaf tissues, greater levels of DGAT activity (TAG production) were observed compared to the AtDGAT1 microsomes. Greater levels of TAG production were observed when the microsomes were supplemented with either C18:2-CoA or C18:3-CoA relative to C18:1-CoA (FIG. 10). This indicated that DGAT2 had a different substrate preference, in particular for C18:3-CoA (ALA), than DGAT1.

Example 9

Co-Expression of MGAT and GPAT in Transgenic Seed

Yang et al. (2010) described two glycerol-3-phosphate acyltransferases (GPAT4 and GPAT6) from *A. thaliana* both having a sn-2 preference (i.e. preferentially forming sn-2 MAG rather than sn-113 MAG) and phosphatase activity, which were able to produce sn-2 MAG from G-3-P (FIG. 1). These enzymes were proposed to be part of the cutin synthesis pathway. GPAT4 and GPAT6 were not expressed highly in seed tissue. Combining such a bifunctional GPAT/phosphatase with a MGAT yields a novel DAG synthesis pathway using G-3-P as a substrate that can replace or supplement the typical Kennedy Pathway for DAG synthesis in plants, particularly in oilseeds, or other cells, which results in increased oil content, in particular TAG levels.

Chimeric DNAs designated pJP3382 and pJP3383, encoding the *A. thaliana* GPAT4 and GPAT6, respectively, together with the *M. musculus* MGAT2 for expression in plant seeds were made by first inserting the entire MGAT2 coding region, contained within a SwaI fragment, into pJP3362 at the SmaI site to yield pJP3378. pJP3362 was a binary expression vector containing empty FAE1 and FP1 expression cassettes and a kanamycin resistance gene as a selectable marker. The *A. thaliana* GPAT4 was amplified from cDNA and cloned into pJP3378 at the NotI site to yield pJP3382 in which the GPAT4 was expressed by the truncated napin promoter, FP1, and the MGAT2 was expressed by the *A. thaliana* FAE1 promoter. Similarly, the *A. thaliana* GPAT6 was amplified from cDNA and cloned into pJP3378 at the NotI site to yield pJP3384 in which the GPAT6 was operably linked to the truncated napin promoter, FP1, and the MGAT2 was expressed by the *A. thaliana* FAE1 promoter. pJP3382 and pJP3383 were transformed into *A. thaliana* (ecotype Columbia) by the floral dip method. Seeds from the treated plants were plated onto media containing the antibiotic, kanamycin, to select for progeny plants (T1 plants) which were transformed. Transgenic seedlings were transferred to soil and grown in the greenhouse. Expression of the transgenes in the developing embryos was determined. Transgenic plants with the highest level of expression and which show a 3:1 ratio for transgenic:non-transgenic plants per line, indicative of a single locus of insertion of the transgenes, are selected and grown to maturity. Seeds were obtained from these plants (T2) which included some which were homozygous for the transgenes. 30 to 32 (T2 plants) from each line were grown in pots of soil in a random arrangement in the greenhouse with control plants, and the lipid content, TAG content and fatty acid compositions of the resultant seed was determined. The total fatty acid content (as determined from the total FAME), in particular the TAG content of the seeds comprising both a MGAT and a GPAT4 or GPAT6 was substantially and significantly increased by nearly 3% (absolute level) or by about 9% (relative increase) over the controls, and increased relative to seeds comprising the MGAT alone or the *A. thaliana* DGAT1 alone (FIG. 11).

The coding region of the mouse MGAT2 gene, codon optimised for expression in plant cells, was introduced into *Brassica napus* together with a chimeric gene encoding *Arabidopsis* GPAT4. Seeds from the resultant transgenic plants were harvested and some were analysed. Data from these preliminary analyses showed variability in the oil content and fatty acid composition, probably due to the plants being grown at different times and under different environmental conditions. Seeds are planted to produce progeny plants, and progeny seeds are harvested.

Example 10

Testing the Effect of GPAT4 and GPAT6 on MGAT-Mediated TAG Increase by GPAT Silencing and Mutation The GPAT family is large and all known members contain two conserved domains, a plsC acyltransferase domain and a HAD-like hydrolase superfamily domain. In addition to this, *A. thaliana* GPAT4-8 all contain an N-terminal region homologous to a phosphoserine phosphatase domain. *A. thaliana* GPAT4 and GPAT6 both contain conserved residues that are known to be critical to phosphatase activity (Yang et al., 2010).

Degenerate primers based on the conserved amino acid sequence GDLVICPEGTTCREP (SEQ ID NO:228) were designed to amplify fragments on *N. benthamiana* GPATs expressed in leaf tissue. 3' RACE will be performed using these primers and oligo-dT reverse primers on RNA isolated from *N. benthamiana* leaf tissue. GPATs with phosphatase activity (i.e. GPAT4/6-like) will be identified by their homology with the N-terminal phosphoserine phosphatase domain region described above. 35S-driven RNAi constructs targeting these genes will be generated and transformed in *A. tumefaciens* strain AGL1. Similarly, a 35S:V2 construct containing the V2 viral silencing-suppressor protein will be transformed in *A. tumefaciens* strain AGL1. V2 is known to suppress the native plant silencing mechanism to allow effective transient expression but also allow RNAi-based gene silencing to function.

TAG accumulation will then be compared between transiently-transformed leaf samples infiltrated with the following strain mixtures: 1) 35S:V2 (negative control); 2) 35S:V2+35S:MGAT2 (positive control); 3) 35S:V2+GPAT-RNAi; 4) 35S:V2+GPAT-RNAi+35S:MGAT2. It is expected that the 35S:V2+GPAT-RNAi+35S:MGAT2 mixture will result in less TAG accumulation than the 35S:V2+35S:MGAT2 sample due to interrupted sn-2 MAG synthesis resulting from the GPAT silencing.

A similar experiment will be performed using *A. thaliana* and *N. benthamiana* GPAT4/6-like sequences which are mutated to remove the conserved residues that are known to be critical to phosphatase activity (Yang et al., 2010). These mutated genes (known collectively as GPAT4/6-delta) will then be cloned into 35S-driven expression binary vectors and transformed in *A. tumefaciens*. TAG accumulation will then be compared between transiently-transformed leaf samples infiltrated with the following strain mixtures: 1) 35S:p19 (negative control); 2) 35S:p19+35S:MGAT2 (positive control); 3) 35S:p19+GPAT4/6-delta; 4) 35S:p19+GPAT4/6-delta+35S:MGAT2. It is expected that the 35S:p19+GPAT4/6-delta+35S:MGAT2 mixture will result in less TAG accumulation than the 35S:p19+35S:MGAT2 sample due to interrupted sn-2 MAG synthesis resulting from the GPAT mutation. Whilst the native *N. benthamiana* GPAT4/6-like genes will be present in this experiment it is expected that high-level expression of the GPAT4/6-delta constructs will outcompete the endogenous genes for access to the G-3-P substrate.

Example 11

Constitutive Expression of a Diacylglycerol Acyltransferase and WRI1 Transcription Factor in Plant Cells A vector designated 35S-pORE04 was made by inserting a PstI fragment containing a 35S promoter into the SfoI site of vector pORE04 after T4 DNA polymerase treatment to blunt the ends (Coutu et al., 2007). A genetic construct 35S:Arath-DGAT1 encoding the *A. thaliana* diacylglycerol acyltransferase DGAT1 (Bouvier-Nave et al., 2000) was made. Example 3 of WO 2009/129582 describes the construction of AtDGAT1 in pXZP163. A PCR amplified fragment with KpnI and EcoRV ends was made from pXZP163 and inserted into pENTR11 to generate pXZP513E. The entire AtDGAT1 coding region of pXZP513E contained within a BamHI-EcoRV fragment was inserted into 35S-pORE04 at the BamHI-EcoRV site, generating pJP2078. A synthetic fragment, Arath-WRI1, coding for the *A. thaliana* WRI1 transcription factor (Cernac and Benning, 2004), flanked by EcoRI restriction sites and codon optimized for *B. napus*, was synthesized. A genetic construct designated 35S:Arath-WRI1 was made by cloning the entire coding region of Arath-WRI1, flanked by EcoRI sites into 35S-pORE04 at the EcoRI site generating pJP3414. Expression of the genes in *N. benthamiana* leaf tissue was performed according to the transient expression system as described in Example 1.

Quantification of TAG levels of infiltrated *N. benthamiana* leaves by Iatroscan revealed that the combined expression of the *A. thaliana* DGAT1 and WRI1 genes resulted in 4.5-fold and 14.3-fold increased TAG content compared to expression of WRI1 and the V2 negative control respectively (Table 9). This corresponded to an average and maximum observed TAG yield per leaf dry weight of 5.7% and 6.51% respectively (Table 9 and FIG. 12). The increase in leaf oil was not solely due to the activity of the overexpressed DGAT1 acyltransferase as was apparent in the reduced TAG levels when WRI1 was left out of the combination. Furthermore, a synergistic effect was observed accounting for 48% of the total TAG increase.

Both DGAT1 and WRI1 constructs also led to increased oleic acid levels at the expense of linoleic acid in TAG fractions of infiltrated *N. benthamiana* leaves (Table 10). These results confirm recent findings by Andrianov et al. (2010) who reported similar shifts in the TAG, phospholipid and TFA lipid fractions of transgenic tobacco plants transformed with the *A. thaliana* DGAT1 acyltransferase. However, when DGAT1 and WRI1 genes were co-expressed, a synergistic effect was observed on the accumulation of oleic acid in the *N. benthamiana* leaves—this synergism accounted for an estimated at 52% of the total oleic acid content when both genes were expressed. The unexpected synergistic effects on both TAG accumulation and oleic acid levels in transgenic *N. benthamiana* leaves demonstrated the potential of simultaneously up-regulating fatty acid biosynthesis and acyl uptake into non-polar lipid such as TAG in vegetative tissues, two metabolic processes that are highly active in developing oilseeds.

The transient expression experiment was repeated except that the P19 viral silencing suppressor as substituted for the V2 suppressor, and with careful comparison of samples on the same leaf to avoid any leaf-to-leaf variation. For this, a chimeric 35S:P19 construct for expression of the tomato bushy stunt virus P19 viral silencing suppressor protein (Wood et al., 2009) was separately introduced into *A. tumefaciens* GV3101 for co-infiltration.

Quantification of TAG levels of infiltrated *N. benthamiana* leaves by Iatroscan in this experiment revealed that the combined transient expression of the *A. thaliana* DGAT1 and WRI1 genes resulted in 141-fold increased TAG content compared to P19 negative control (FIG. 13). When compared to the expression of the DGAT1 and WRI1 genes separately on the same leaf, the combined infiltration increased TAG levels by 17- and 5-fold respectively. Once again, the co-expression of both genes had a synergistic (larger than additive) effect on leaf oil accumulation with the synergistic component accounting for 73% of the total TAG increase. The greater extent of the increased TAG content in this experiment (141-fold) compared to the previous experiment (14.3-fold) may have been due to use of the P19 silencing suppressor rather than V2 and therefore increased gene expression from the transgenes.

Table 11 shows the fatty acid composition of the TAG. When DGAT1 and WRI1 genes were co-expressed in *N. benthamiana*, a synergistic effect was once again observed on the level of oleic acid accumulation in the leaf TAG fraction. This increase was largely at the expense of the medium chain unsaturated fatty acids palmitic acid and stearic acid (Table 11). Linoleic acid was also increased which can be explained by the higher oleic acid substrate levels available to the endogenous FAD2 Δ12-desaturase. Individual expression of the DGAT1 and WRI1 genes in *N. benthamiana* led to intermediate changes in the TAG profile without as great an increase in oleic acid. In addition, but in contrast to the first experiment, higher levels of α-linolenic acid (ALA) were detected while this was observed to a lesser extent upon the DGAT1 and WRI1 co-expression in leaf tissue.

The observed synergistic effect of DGAT1 and WRI1 expression on TAG biosynthesis was confirmed in more detail by comparing the effect of introduction into *N. benthamiana* of both genes individually or in combination, compared to introduction of a P19 gene alone as a control, within the same leaf. This was beneficial in reducing leaf to leaf variation. In addition, the number of replicates was increased to 5 and samples were pooled across different leaves from the same plant to improve the quality of the data. Results are presented in Table 12.

TABLE 8

Fatty acid profile and quantification of TAG in triplicate *Nicotiana benthamiana* leaf tissue transiently transformed with the 35S:p19, 35S:DGAT1 and 35S:DGAT2 constructs.

| Sample | C16:0 | 16:1w13t | C16:1d7 | 16:3w3 | C18:0 | C18:1 | C18:1d11 | C18:2 |
|---|---|---|---|---|---|---|---|---|
| P19 | 44.7 | 0.1 | 0.0 | 0.0 | 33.9 | 1.2 | 0.0 | 6.5 |
|  | 44.1 | 1.7 | 0.0 | 0.0 | 15.3 | 2.0 | 0.0 | 15.2 |
|  | 43.3 | 1.5 | 0.0 | 0.0 | 10.5 | 1.5 | 0.0 | 17.2 |
| P19 + AtDGAT1 | 36.3 | 0.5 | 0.1 | 0.4 | 11.6 | 2.3 | 0.3 | 17.8 |
|  | 33.6 | 0.5 | 0.1 | 0.4 | 11.2 | 2.9 | 0.3 | 23.1 |
|  | 36.8 | 0.5 | 0.0 | 0.0 | 12.4 | 2.9 | 0.4 | 21.3 |
| P19 + AtDGAT2 | 18.6 | 0.3 | 0.1 | 0.5 | 9.3 | 7.7 | 0.4 | 28.0 |
|  | 17.5 | 0.3 | 0.1 | 0.3 | 10.2 | 9.9 | 0.5 | 32.7 |
|  | 18.4 | 0.3 | 0.1 | 0.3 | 9.8 | 7.5 | 0.5 | 32.3 |

| Sample | C18:3 | C20:0 | 20:1d11 | 20:2 | 20:3n3 | C22:0 | C24:0 | µg/100 mg DW |
|---|---|---|---|---|---|---|---|---|
| P19 | 12.7 | 0.9 | 0.0 | 0.0 | 0.0 | 0.0 | 0.0 | 43.29 |
|  | 19.5 | 2.2 | 0.0 | 0.0 | 0.0 | 0.0 | 0.0 | 23.12 |
|  | 23.9 | 2.2 | 0.0 | 0.0 | 0.0 | 0.0 | 0.0 | 38.35 |
| P19 + AtDGAT1 | 24.5 | 3.6 | 0.0 | 0.0 | 0.2 | 1.5 | 0.2 | 144.77 |
|  | 21.5 | 3.8 | 0.0 | 0.0 | 0.2 | 1.5 | 0.9 | 145.34 |
|  | 19.3 | 3.9 | 0.0 | 0.0 | 0.0 | 1.5 | 1.0 | 90.04 |
| P19 + AtDGAT2 | 33.1 | 1.1 | 0.2 | 0.1 | 0.1 | 0.2 | 0.3 | 439.25 |
|  | 26.5 | 1.2 | 0.1 | 0.0 | 0.1 | 0.2 | 0.4 | 282.50 |
|  | 29.1 | 1.2 | 0.0 | 0.0 | 0.0 | 0.3 | 0.2 | 208.40 |

TABLE 9

TAG levels in triplicate *Nicotiana benthamiana* leaf tissue transiently transformed with 35S:V2, 35S:DGAT1 and 35S:WRI1.

| Control combination | TAG (% dry weight) [1] | Genes expressed | TAG (% dry weight) [1] | Ratio [2] |
|---|---|---|---|---|
| V2 | 0.41 ± 0.10 | V2, WRI1, DGAT1 | 5.71 ± 0.63 | 14.28 ± 1.89 |
| V2, WRI1 | 1.16 ± 0.60 | V2, WRI1, DGAT1 | 4.25 ± 0.64 | 4.45 ± 2.24 |
| V2, DGAT1 | 1.52 ± 0.34 | V2, WRI1, DGAT1 | 4.76 ± 0.50 | 3.22 ± 0.75 |

[1] Average of three different infiltrated leaves as quantified by Iatroscan
[2] Average ratio based on side-by-side comparisons on the same leaves

TABLE 10

Fatty acid composition of TAG produced in *Nicotiana benthamiana* leaf tissue transiently transformed with 35S:V2, 35S:DGAT1 and 35S:WRI1 (data from triplicate infiltrations).

| Fatty acid | V2 | V2, WRI1, DGAT1 | V2, WRI1 | V2, WRI1, DGAT1 | V2, DGAT1 | V2, WRI1, DGAT1 |
|---|---|---|---|---|---|---|
| C14:0 | 0 | 0 | 0 | 0 | 0 | 0 |
| C14:1$^{\Delta 9}$ | 1.26 ± 2.18 | 0.05 ± 0.10 | 0 | 0.04 ± 0.08 | 0 | 0.04 ± 0.07 |
| C16:0 | 46.12 ± 0.97 | 30.60 ± 0.41 | 50.09 ± 6.27 | 31.32 ± 3.31 | 35.44 ± 0.80 | 26.61 ± 1.41 |
| C16:1$^{\Delta 9}$ | 0 | 0.13 ± 0.11 | 0 | 0.07 ± 0.11 | 0 | 0.13 ± 0.12 |
| C18:0 | 13.44 ± 1.65 | 9.93 ± 1.19 | 9.28 ± 0.81 | 9.93 ± 0.53 | 12.20 ± 1.03 | 8.76 ± 0.91 |
| C18:1$^{\Delta 9}$ | 5.09 ± 5.32 | 36.78 ± 2.23 | 9.72 ± 5.08 | 27.97 ± 4.19 | 8.77 ± 1.97 | 32.41 ± 1.39 |
| C18:1$^{\Delta 11}$ | 0 | 0.56 ± 0.04 | 0 | 0.51 ± 0.04 | 0 | 0.55 ± 0.04 |
| C18:2$^{\Delta 9,12}$ | 14.12 ± 0.75 | 11.83 ± 0.75 | 13.26 ± 1.95 | 16.45 ± 3.88 | 18.93 ± 0.77 | 17.03 ± 1.36 |
| C18:3$^{\Delta 9,12,15}$ | 19.98 ± 6.33 | 4.77 ± 1.17 | 17.10 ± 4.31 | 8.75 ± 2.13 | 16.12 ± 3.36 | 9.57 ± 0.61 |
| C20:0 | 0 | 2.63 ± 0.27 | 0.54 ± 0.93 | 2.53 ± 0.16 | 4.25 ± 0.33 | 2.43 ± 0.26 |
| C22:0 | 0 | 1.56 ± 0.1 | 0 | 1.38 ± 0.03 | 2.37 ± 0.11 | 1.40 ± 0.13 |
| C24:0 | 0 | 1.17 ± 0.15 | 0 | 1.05 ± 0.07 | 1.92 ± 0.16 | 1.07 ± 0.16 |

TABLE 11

Fatty acid composition of TAG produced in N. benthamiana leaf tissues transiently transformed with 35S:P19 (control), 35S:WRI1 and/or 35S:DGAT1 constructs.

| Fatty acid | P19 | P19 + WRI1 | P19 + DGAT1 | P19 + WRI1 + DGAT1 |
|---|---|---|---|---|
| C14:0 | 3.0 ± 2.2 | 0.6 ± 0.1 | 0.2 ± 0.1 | 0.1 ± 0.0 |
| C16:0 | 46.5 ± 4.1 | 48.7 ± 11.5 | 28.4 ± 0.3 | 28.1 ± 1.0 |
| C16:1$^{\Delta 3t}$ | 1.3 ± 2.2 | 0.3 ± 0.3 | 0.5 ± 0.0 | 0.3 ± 0.0 |
| C16:1$^{\Delta 9}$ | 0.0 | 0.9 ± 0.2 | 0.2 ± 0.0 | 0.4 ± 0.1 |
| C16:3$^{\Delta 7, 12, 15}$ | 0.0 | 0.2 ± 0.2 | 0.5 ± 0.1 | 0.3 ± 0.0 |
| C18:0 | 18.7 ± 4.7 | 7.9 ± 2.6 | 11.5 ± 0.6 | 7.2 ± 0.4 |
| C18:1$^{\Delta 9}$ | 5.5 ± 1.3 | 3.9 ± 0.3 | 6.3 ± 0.2 | 19.4 ± 2.7 |
| C18:1$^{\Delta 11}$ | 0.0 | 0.6 ± 0.1 | 0.2 ± 0.0 | 0.6 ± 0.1 |
| C18:2$^{\Delta 9, 12}$ | 11.3 ± 4.2 | 12.7 ± 3.6 | 25.2 ± 0.5 | 26.3 ± 1.0 |
| C18:3$^{\Delta 9, 12, 15}$ | 9.3 ± 3.6 | 21.6 ± 10.3 | 18.1 ± 0.6 | 11.2 ± 0.7 |
| C20:0 | 2.7 ± 0.2 | 1.4 ± 0.5 | 4.4 ± 0.1 | 2.7 ± 0.1 |
| C20:1$^{\Delta 11}$ | 0.0 | 0.0 | 0.3 ± 0.0 | 0.3 ± 0.0 |
| C20:2$^{\Delta 11, 14}$ | 0.0 | 0.0 | 0.1 ± 0.1 | 0.2 ± 0.0 |
| C20:3$\Delta^{11, 14, 17}$ | 0.0 | 0.0 | 0.1 ± 0.0 | 0.1 ± 0.0 |
| C22:0 | 1.5 ± 0.1 | 0.7 ± 0.1 | 2.3 ± 0.0 | 1.8 ± 0.1 |
| C24:0 | 0.4 ± 0.6 | 0.5 ± 0.2 | 1.6 ± 0.1 | 1.0 ± 0.1 |

TABLE 12

Comparison of WRI1 + DGAT1 together with the single genes

| Gene combination | TAG level (% dry weight) | Ratio (compared to P19) |
|---|---|---|
| P19 (control) | 0.01 ± 0.00 | 1 |
| P19 + WRI1 | 0.08 ± 0.04 | 8 |
| P19 + DGAT1 | 0.27 ± 0.03 | 27 |
| P19 + WRI1 + DGAT1 | 1.29 ± 0.26 | 129 |

Based on the individual effects of both DGAT1 and WRI1 genes upon expression in N. benthamiana, in the presence of merely an additive effect but the absence of any synergistic effect, the present inventors expected a TAG level of about 0.35 or a 35-fold increase compared to the P19 negative control. However, the introduction of both genes resulted in TAG levels that were 129-fold higher than the P19 control. Based on these results, the present inventors estimated the additive effect and the synergistic effect on TAG accumulation as 26.9% and 73.1%, respectively. In addition, when the fatty acid composition of the total lipid in the leaf samples was analysed by GC, a synergistic effect was observed on C18:1$^{\Delta 9}$ levels in the TAG fraction of N. benthamiana leaves infiltrated with WRI1 and DGAT1 (3 repeats each). The data is shown in Table 11.

For seed-specific expression of the WRI1+DGAT1 combination, Arabidopsis thaliana was transformed with a binary vector construct including a chimeric DNA having both pFAE1::WRI1 and pCln2::DGAT1 genes, or, for comparison, the single genes pFAE1::WRI1 or pCln2::DGAT1. T1 seeds were harvested from the plants. The oil content of the seeds is determined. The seeds have an increased oil content.

Example 12

Constitutive Expression of a Monoacylglycerol Acyltransferase and WRI1 Transcription Factor in Plant Cells A chimeric DNA encoding the Mus musculus MGAT2 (Cao et al., 2003; Yen and Farese, 2003) and codon-optimised for B. napus was synthesized by Geneart. A genetic construct designated 35S:Musmu-MGAT2 was made by inserting the entire coding region of 1022341_MusmuMGAT2, contained within an EcoRI fragment, into pJP3343 at the EcoRI site, generating pJP3347. Cloning of the 35S:Arath-WRI1 construct is described in Example 11. Transient expression in N. benthamiana leaf tissue was performed as described in Example 1.

When the mouse MGAT2 and the A. thaliana WRI1 transcription vector were coexpressed, average N. benthamiana leaf TAG levels were increased by 3.3-fold compared to the expression of WRI1 alone (Table 13). In addition, the expression of the two genes resulted in a small (29%) synergistic effect on the accumulation of leaf TAG. The TAG level obtained with the MGAT2 gene in the presence of WRI1 was 3.78% as quantified by Iatroscan (FIG. 12). The similar results obtained with the animal MGAT2 and plant DGAT1 acyltransferases in combination with the A. thaliana WRI1 suggests that a synergistic effect might be a general phenomenon when WRI and acyltransferases are overexpressed in non-oil accumulating vegetative plant tissues.

The experiment was repeated to introduce constructs for expressing V2+MGAT2 compared to V2+MGAT2+WRI1, such that infiltrated leaf samples were pooled across three leaves from the same plant, for two plants each. In total, each combination therefore had 6 replicate infiltrations. This yielded a smaller standard deviation than pooling leaf samples between different plants as was done in the first experiments. The data from this experiment is shown in Table 14. Earlier results (Table 13) were confirmed. Although absolute TAG levels are different (inherent to the Benth assay and also different pooling of samples), relative increase in TAG when WRI1 is co-expressed with V2+MGAT2 are similar (2.45- and 2.65-fold).

Example 13

Constitutive Expression of a Monoacylglycerol Acyltransferase, Diacylglycerol Acyltransferase and WRI1 Transcription Factor in Plant Cells The genes coding for the A. thaliana diacylglycerol acyltransferase DGAT1, the mouse monoacylglycerol acyltransferase MGAT2 and the A. thaliana WRI1 were expressed in different combinations in N. benthamiana leaf tissue according to the transient expression system as described in Example 1. A detailed description of the different constructs can be found in Examples 11 and 12.

The combined expression of the DGAT1, WRI1 and MGAT2 genes resulted in an almost 3-fold further average TAG increase when compared to the expression of the latter two (Table 15). The maximum observed TAG yield obtained was 7.28% as quantified by Iatroscan (FIG. 12). Leaf TAG levels were not significantly affected when the gene of the mouse MGAT2 acyltransferase was left out this combination. Results described in Example 16, however, clearly demonstrated the positive effect of the mouse MGAT2 on the biosynthesis of neutral lipids in *N. benthamiana* leaves when expressed in combination with WRI1, DGAT1 and the *Sesamum indicum* oleos in protein.

TABLE 13

TAG levels in triplicate *Nicotiana benthamiana* leaf tissue transiently transformed with 35S:V2, 35S:MGAT2 and 35S:WRI1.

| Control combination | TAG (% dry weight) [1] | Genes expressed | TAG (% dry weight) [1] | Ratio [2] |
|---|---|---|---|---|
| V2, WRI1 | 0.93 ± 0.37 | V2, WRI1, MGAT2 | 2.88 ± 0.56 | 3.30 ± 0.85 |
| V2, MGAT2 | 1.56 ± 0.76 | V2, WRI1, MGAT2 | 3.15 ± 1.05 | 2.45 ± 1.73 |

[1] Average of three different infiltrated leaves as quantified by Iatroscan
[2] Average ratio based on side-by-side comparisons on the same leaves

TABLE 14

TAG content of infiltrated *N. benthamiana* leaf samples.

| Gene combination | TAG (% dry weight) | Ratio |
|---|---|---|
| V2 + MGAT2 | 0.34 ± 0.04 | 2.65 |
| V2 + MGAT2 + WRI1 | 0.9 ± 0.19 | |

TABLE 15

TAG levels in triplicate *Nicotiana benthamiana* leaf tissue transiently transformed with 35S:V2, 35S:MGAT2, 35S:DGAT1 and 35S:WRI1.

| Control combination | TAG (% dry weight) [1] | Genes expressed | TAG (% dry weight) [1] | Ratio [2] |
|---|---|---|---|---|
| V2, WRI1, DGAT1 | 3.35 ± 0.29 | V2, WRI1, MGAT2, DGAT1 | 3.15 ± 0.49 | 0.94 ± 0.01 |
| V2, WRI1, MGAT2 | 1.72 ± 0.56 | V2, WRI1, MGAT2, DGAT1 | 4.62 ± 0.47 | 2.88 ± 0.90 |

[1] Average of three different infiltrated leaves as quantified by Iatroscan
[2] Average ratio based on side-by-side comparisons on the same leaves Additional data was obtained from a further experiment where leaf samples were pooling across leaves within same plant, 6 replicates of each. The data is shown in Table 16.

TABLE 16

TAG content of infiltrated *N. benthamiana* leaf samples.

| Gene combination | TAG (% dry weight) | Ratio |
|---|---|---|
| V2 + MGAT2 + DGAT1 | 1.08 ± 0.1 | 2.06 |
| V2 + MGAT2 + DGAT1 + WRI1 | 2.22 ± 0.31 | |

Example 14

Constitutive Expression of a Monoacylglycerol Acyltransferase, Diacycerol Acyltransferase, WRI1 Transcription Factor and Glycerol-3-Phosphate Acyltransferase in Plant Cells A 35S:GPAT4 genetic construct was made by cloning the *A. thaliana* GPAT4 gene (Zheng et al., 2003) from total RNA isolated from developing siliques, followed by insertion as an EcoRI fragment into pJP3343 resulting in pJP3344. Other constructs are described in Examples 11 and 12. Transient expression in *N. benthamiana* leaf tissue was performed as described in Example 1.

Transient expression of the *A. thaliana* GPAT4 acyltransferase in combination with MGAT2, DGAT1 and WRI1 led to a small decrease in the *N. benthamiana* leaf TAG content as quantified by Iatroscan (Table 17). The TAG level (5.78%) was also found to be lower when GPAT4 was included in the infiltration mixture (FIG. 12). However, this finding does not rule out the hypothesis of sn2-MAG synthesis from G3P as catalysed by the GPAT4 acyltransferase. Rather, it suggests that this catalytic step is unlikely to be rate limiting in leaf tissue due to the high expression levels of the endogenous GPAT4 gene (Li et al., 2007). Moreover, the *A. thaliana* GPAT8 acyltransferase displays a similar expression profile as GPAT4 and has been shown to exhibit an overlapping function (Li et al., 2007). In developing seeds the expression levels of GPAT4 and GPAT8 are low. As a result, coexpression of GPAT4 in a seed context might be crucial to ensure sufficient sn2-MAG substrate for a heterologous expressed MGAT acyltransferase.

TABLE 17

TAG levels in triplicate *Nicotiana benthamiana* leaf tissue transiently transformed with 35S:V2, 35S:MGAT2, 35S:DGAT1, 35S:WRI1 and 35S:GPAT4.

| Control combination | TAG (% dry weight)[1] | Genes expressed | TAG (% dry weight)[1] | Ratio[2] |
|---|---|---|---|---|
| V2, WRI1, MGAT2, DGAT1 | 4.14 ± 0.82 | V2, WRI1, MGAT2, DGAT1, GPAT4 | 3.11 ± 0.20 | 0.77 ± 0.13 |
| V2, WRI1, DGAT1, GPAT4 | 2.76 ± 0.74 | V2, WRI1, MGAT2, DGAT1, GPAT4 | 4.05 ± 1.24 | 1.47 ± 0.22 |

Additional data was obtained from a further experiment where leaf samples were pooling across leaves within same plant, 6 replicates of each. The data is shown in Table 18.

TABLE 18

TAG content of infiltrated *N. benthamiana* leaf samples.

| Gene combination | TAG (% dry weight) | Ratio |
|---|---|---|
| V2 + MGAT2 + DGAT1 | 1.54 ± 0.36 | 1.01 |
| V2 + MGAT2 + DGAT1 + GPAT4 | 1.56 ± 0.18 | | between the pENTR11-NCOI-NtAGP entry clone and the pHELLSGATE12 destination vector generated pTV35, a binary vector containing the NtAGPase RNAi cassette under the control of the 35S promotor. Other constructs are described in Examples 11 and 12. Transient expression in *N. benthamiana* leaf tissue was performed as described in Example 1.

Expression of the *N. tabacum* AGPase silencing construct together with the genes coding for MGAT2 and WRI resulted in a 1.7-fold increase in leaf TAG levels as quantified by Iatroscan (Table 19). In the absence of the MGAT2 acyltransferase TAG levels dropped almost 3-fold. Therefore the observed TAG increase cannot be attributed solely to the silencing of the endogenous *N. benthamiana* AGPase gene. Surprisingly, substituting MGAT2 for the *A. thaliana* DGAT1 did not alter TAG levels in infiltrated *N. benthamiana* leaves in combination with the *N. tabacum* AGPase silencing construct. Silencing of the *N. benthamiana* AGPase therefore appears to have a different metabolic effect on MGAT and DGAT acyltransferases. A similar difference is also observed in the maximum observed TAG levels with WRI1 and the AGPase silencing construct in combination with MGAT2 or DGAT1 yielding 6.16% and 5.51% leaf oil respectively (FIG. 12).

TABLE 19

TAG levels in triplicate *Nicotiana benthamiana* leaf tissue transiently transformed with 35S:V2, 35S:MGAT2, 35S:DGAT1, 35S:WRI1 and 35S:AGPase-hpRNAi

| Control combination | TAG (% dry weight)[1] | Genes expressed | TAG (% dry weight)[1] | Ratio[2] |
|---|---|---|---|---|
| V2, WRI1, MGAT2 | 2.33 ± 1.23 | V2, WRI1, MGAT2, AGPase-hpRNAi | 3.60 ± 0.98 | 1.69 ± 0.40 |
| V2, WRI1, AGPase-hpRNAi | 1.86 ± 0.20 | V2, WRI1, MGAT2, AGPase-hpRNAi | 5.21 ± 1.48 | 2.87 ± 1.01 |
| V2, WRI1, DGAT1 | 4.99 ± 0.95 | V2, WRI1, DGAT1, AGPase-hpRNAi | 4.77 ± 0.79 | 0.96 ± 0.07 |

[1] Average of three different infiltrated leaves as quantified by Iatroscan;
[2] Average ratio based on side-by-side comparisons on the same leaves Example 15

Constitutive Expression of a Monoacylglycerol Acyltransferase, Diacyverol Acyltransferase, WRI1 Transcription Factor and AGPase-hpRNAi Silencing Construct in Plant Cells A DNA fragment corresponding to nucleotides 595 to 1187 of the mRNA encoding the *Nicotiana tabacum* AGPase small subunit (DQ399915) (Kwak et al., 2007) was synthesized. The 593 bp 1118501_NtAGP fragment was first cut with NcoI, treated with DNA polymerase I large (Klenow) fragment to generate 5' blunt ends and finally digested with XhoI. Similarly, the pENTR11-NCOI entry vector was first digested with BamHI, treated with DNA polymerase I large (Klenow) fragment and cut with XhoI. Ligation of the 1118501_NtAGP insert into pENTR11-NCOI generated the pENTR11-NCOI-NtAGP entry clone. LR recombination Overexpression of WRI1 and MGAT in combination with AGPase silencing is particularly promising to increase oil yields in starch accumulating tissues. Examples include tubers such as for potatoes, and the endosperm of cereals, potentially leading to cereals with increased grain oil content (Barthole et al., 2011). Although *N. tabacum* and *N. benthamiana* AGPase genes are likely to bear significant sequence identity, it is likely that a *N. benthamiana* AGPase-hpRNAi construct will further elevate TAG yields due to improved silencing efficiency.

Additional data was obtained from a further experiment where leaf samples were pooled across leaves within same plant, 6 replicates of each. The data is shown in Tables 19 and 20.

TABLE 20

TAG content of infiltrated N. benthamiana leaf samples.

| Gene combination | TAG (% dry weight) | Ratio |
|---|---|---|
| V2 + MGAT2 + DGAT1 + WRI1 + Oleosin | 1.93 ± 0.18 | 1.14 |
| V2 + MGAT2 + DGAT1 + WRI1 + Oleosin + AGPase-hpRNAi | 2.19 ± 0.19 | |

Example 16

Constitutive Expression of a Monoacylglycerol Acyltransferase, Diacycerol Acyltransferase, WRI1 Transcription Factor and an Oleosin Protein in Plant Cells A pRSh1 binary vector containing the gene coding for the S. indicum seed oleosin (Scott et al., 2010) under the control of the 35S promotor was provided by Dr. N. Roberts (AgResearch Limited, New Zealand). Other constructs are described in Examples 11 and 12. Transient expression in N. benthamiana leaf tissue was performed as described in Example 1.

When the sesame oleosin protein was expressed together with the A. thaliana WRI transcription factor and M. musculus MGAT2 acyltransferase, TAG levels in N. benthamiana leaves as quantified by Iatroscan were found to be 2.2-fold higher (Table 21). No significant changes in the leaf TAG fatty acid profiles were detected (Table 22). A small increase in TAG was also observed when the A. thaliana DGAT1 acyltransferase was included. Compared to the V2 negative control, the combined expression of WRI1, DGAT1 and the sesame oleosin protein resulted in a 3-fold TAG increase and a maximum observed TAG level of 7.72% (Table 21 and FIG. 12). Leaf TAG levels were further elevated by a factor of 2.5 upon including the MGAT2 acyltransferase. This corresponded to an average of 5.7% and a maximum observed of 18.8% TAG on a dry weight basis. The additional increase in leaf TAG when MGAT2 was included clearly demonstrates the positive effect of this acyltransferase on the biosynthesis and accumulation of neutral lipids in transgenic leaf tissues.

The experiment was repeated with the combination of genes for expressing V2 and V2+MGAT2+DGAT1+WRI1+Oleosin, tested in different N. benthamiana plants, with samples pooled across leaves from the same plant and with 12 replicate infiltrations for each. The data is shown in Table 23. Replicate samples were also pooled across leaves from same plant, with 6 repeats for each infiltration: The data is shown in Tables 24 and 25.

Although infiltration of N. benthamiana leaves resulted in increased levels of leaf oil (TAG), no significant increase in the total lipid content was detected, suggesting that a redistribution of fatty acids from different lipids pools into TAG was occurring. In contrast, when the MGAT2 gene was coexpressed with the DGAT1, WRI1 and oleosin genes, total lipids were increased 2.21-fold, demonstrating a net increase in the synthesis of leaf lipids.

Example 17

Constitutive Expression of a Monoacylglycerol Acyltransferase, Diacylglycerol Acyltransferase, WRI1 Transcription Factor and a FAD2-hpRNAi Silencing Construct in Plant Cells A N. benthamiana FAD2 RNAi cassette under the control of a 35S promotor was obtained by LR recombination into the pHELLSGATE8 destination vector to generate vector pFN033. Other constructs are described in Examples 11 and 12.

TABLE 21

TAG levels in triplicate Nicotiana benthamiana leaf tissue transiently transformed with 35S:V2, 35S:MGAT2, 35S:DGAT1, 35S:WRI1 and 35S:Oleosin.

| Control combination | TAG (% dry weight) [1] | Genes expressed | TAG (% dry weight) [1] | Ratio [2] |
|---|---|---|---|---|
| V2, WRI1, MGAT2 | 1.77 ± 0.75 | V2, WRI1, MGAT2, Oleosin | 3.34 ± 0.19 | 2.20 ± 1.10 |
| V2, WRI1, Oleosin | 1.31 ± 0.19 | V2, WRI1, MGAT2, Oleosin | 2.36 ± 1.10 | 1.79 ± 0.84 |
| V2, WRI1, DGAT1 | 4.82 ± 1.67 | V2, WRI1, DGAT1, Oleosin | 6.02 ± 1.57 | 1.32 ± 0.43 |
| V2, WRI1, MGAT2, DGAT1 | 5.17 ± 1.87 | V2, WRI1, MGAT2, DGAT1, Oleosin | 6.34 ± 1.74 | 1.25 ± 0.11 |
| V2, WRI1, DGAT1, Oleosin | 4.61 ± 1.83 | V2, WRI1, MGAT2, DGAT1, Oleosin | 5.48 ± 1.39 | 1.24 ± 0.26 |
| V2 | 1.46 ± 0.67 | V2, WRI1, DGAT1, Oleosin | 3.71 ± 1.50 | 3.00 ± 1.63 |
| V2 | 0.90 ± 0.43 | V2, WRI1, MGAT2, DGAT1, Oleosin | 5.74 ± 0.22 | 7.45 ± 3.52 |

[1] Average of three different infiltrated leaves as quantified by Iatroscan
[2] Average ratio based on side-by-side comparisons on the same leaves

TABLE 22

TAG fatty acid profiles of triplicate Nicotiana benthamiana leaf tissue transiently transformed with 35S:V2, 35S:MGAT2, 35S:DGAT1, 35S:WRI1 and 35S:Oleosin.

| Fatty acid | V2, WRI1, DGAT1 | V2, WRI1, DGAT1, Oleosin | V2, WRI1, MGAT2, DGAT1 | V2, WRI1, MGAT2, DGAT1, Oleosin |
|---|---|---|---|---|
| C14:0 | 0.05 ± 0.04 | 0.02 ± 0.04 | 0.05 ± 0.05 | 0.04 ± 0.04 |
| C14:1$^{\Delta 9}$ | 0.14 ± 0.03 | 0.10 ± 0.09 | 0 | 0 |
| C16:0 | 30.64 ± 1.32 | 29.96 ± 1.23 | 25.53 ± 2.30 | 23.74 ± 1.83 |
| C16:1$^{\Delta 9}$ | 0.39 ± 0.17 | 0.32 ± 0.33 | 0.19 ± 0.02 | 0.36 ± 0.10 |
| C18:0 | 9.85 ± 0.34 | 10.23 ± 0.20 | 8.50 ± 1.42 | 8.30 ± 0.73 |
| C18:1$^{\Delta 9}$ | 38.17 ± 1.28 | 39.01 ± 1.87 | 35.14 ± 6.58 | 38.64 ± 5.12 |
| C18:1$^{\Delta 11}$ | 0.66 ± 0.04 | 0.74 ± 0.20 | 0.53 ± 0.06 | 0.56 ± 0.02 |
| C18:2$^{\Delta 9, 12}$ | 11.58 ± 0.52 | 11.53 ± 0.86 | 16.48 ± 1.40 | 15.75 ± 1.58 |
| C18:3$^{\Delta 9, 12, 15}$ | 3.80 ± 0.32 | 3.97 ± 0.29 | 9.35 ± 0.74 | 9.61 ± 0.87 |
| C20:0 | 2.50 ± 0.20 | 2.41 ± 0.15 | 2.17 ± 0.42 | 1.64 ± 0.11 |

TABLE 22-continued

TAG fatty acid profiles of triplicate Nicotiana benthamiana leaf tissue transiently transformed with 35S:V2, 35S:MGAT2, 35S:DGAT1, 35S:WRI1 and 35S:Oleosin.

| Fatty acid | V2, WRI1, DGAT1 | V2, WRI1, DGAT1, Oleosin | V2, WRI1, MGAT2, DGAT1 | V2, WRI1, MGAT2, DGAT1, Oleosin |
|---|---|---|---|---|
| C22:0 | 1.33 ± 0.21 | 1.16 ± 0.11 | 1.22 ± 0.22 | 0.80 ± 0.04 |
| C24:0 | 0.90 ± 0.19 | 0.55 ± 0.48 | 0.85 ± 0.23 | 0.55 ± 0.06 |

TABLE 23

TAG content of infiltrated N. benthamiana leaf samples.

| Gene combination | TAG (% dry weight) | Ratio |
|---|---|---|
| V2 | 0.19 ± 0.05 | 18.74 |
| V2 + MGAT2 + DGAT1 + WRI1 + Oleosin | 3.56 ± 0.86 | |

TABLE 24

TAG content of infiltrated N. benthamiana leaf samples.

| Gene combination | TAG (% dry weight) | Ratio |
|---|---|---|
| V2 + MGAT2 + DGAT1 + WRI1 | 2.17 ± 0.30 | 0.79 |
| V2 + MGAT2 + DGAT1 + WRI1 + Oleosin | 2.11 ± 0.20 | |
| V2 + MGAT2 | 0.32 ± 0.06 | 2.19 |
| V2 + MGAT2 + Oleosin | 0.70 ± 0.17 | |

TABLE 25

Total fatty acid content of infiltrated N. benthamiana leaf samples.

| | | |
|---|---|---|
| V2 | 3.12 ± 0.14 | 1 |
| V2 + MGAT2 | 3.28 ± 0.33 | 1.05 |
| V2 + MGAT2 + DGAT1 + WRI1 + Oleosin | 6.88 ± 0.37 | 2.21 |

The genes coding for the mouse monoacylglycerol acyltransferase MGAT2, *A. thaliana* diacylglycerol acyltransferase DGAT1, *A. thaliana* WRI1 and a *N. benthamiana* FAD2 Δ12-fatty acid desaturase hairpin RNAi construct (Wood et al., manuscript in preparation) were expressed in combination in *N. benthamiana* leaf tissue using the transient expression system as described in Example 1.

Similar changes were observed in the fatty acid compositions of TAG, polar lipids and TFA of *N. benthamiana* leaves infiltrated with WRI1, MGAT2, DGAT1 and the Fad2 silencing contruct (Tables 26-28). In all three lipid fractions, oleic acid levels were further increased and reached almost 20% in polar lipids, 40% in TFA and more than 55% in TAG. This increase came mostly at the expense of linoleic acid reflecting the silencing effect on the endoplasmic reticulum FAD2 Δ12-desaturase. Leaf TAG also contained less α-linolenic acid while levels in TFA and polar lipids were unaffected.

When these experiments were repeated and the fatty acid compositions determined for TAG, polar lipids and total lipids, the results (Table 29) were consistent with the first experiment.

TABLE 26

TAG fatty acid profiles of triplicate Nicotiana benthamiana leaf tissue transiently transformed with 35S:V2, 35S:MGAT2, 35S:DGAT1, 35S:WRI1 and 35S:FAD2-hpRNAi.

| Fatty acid | V2 | V2, WRI1, MGAT2, DGAT1 | V2, WRI1, MGAT2, DGAT1, FAD2-hpRNAi |
|---|---|---|---|
| C14:1$^{\Delta 9}$ | 0.28 ± 0.48 | 0.14 ± 0.12 | 0.08 ± 0.13 |
| C16:0 | 22.73 ± 0.40 | 22.63 ± 1.43 | 19.11 ± 1.62 |
| C16:1$^{\Delta 9}$ | 0 | 0.28 ± 0.02 | 0.51 ± 0.11 |
| C18:0 | 7.31 ± 1.44 | 5.27 ± 0.19 | 5.05 ± 0.11 |
| C18:1$^{\Delta 9}$ | 29.87 ± 11.91 | 32.21 ± 4.73 | 55.21 ± 1.31 |
| C18:1$^{\Delta 11}$ | 0 | 0.80 ± 0.04 | 0.89 ± 0.04 |
| C18:2$^{\Delta 9, 12}$ | 13.36 ± 3.22 | 20.23 ± 3.36 | 3.61 ± 0.18 |
| C18:3$^{\Delta 9, 12, 15}$ | 25.03 ± 10.14 | 15.18 ± 0.89 | 12.03 ± 0.72 |
| C20:0 | 0.99 ± 0.86 | 1.38 ± 0.07 | 1.41 ± 0.04 |
| C20:1$^{\Delta 11}$ | 0 | 0.39 ± 0.05 | 0.62 ± 0.02 |
| C22:0 | 0 | 0.85 ± 0.04 | 0.83 ± 0.05 |
| C24:0 | 0.44 ± 0.76 | 0.64 ± 0.08 | 0.66 ± 0.05 |

TABLE 27

Fatty acid profiles of polar lipids isolated from triplicate
Nicotiana benthamiana leaf tissue transiently transformed with
35S:V2, 35S:MGAT2, 35S:DGAT1, 35S:WRI1 and 35S:FAD2-hpRNAi.

| Fatty acid | V2 | V2, WRI1, MGAT2, DGAT1 | V2, WRI1, MGAT2, DGAT1, FAD2-hpRNAi |
|---|---|---|---|
| $C14:1^{\Delta 9}$ | 0.13 ± 0.23 | 0.17 ± 0.15 | 0 |
| C16:0 | 15.00 ± 0.30 | 15.99 ± 0.14 | 15.28 ± 0.31 |
| $C16:1^{\Delta 9}$ | 2.66 ± 0.28 | 1.97 ± 0.40 | 2.09 ± 0.16 |
| C18:0 | 2.47 ± 0.14 | 2.05 ± 0.18 | 1.95 ± 0.09 |
| $C18:1^{\Delta 9}$ | 5.12 ± 2.22 | 10.57 ± 1.99 | 18.99 ± 0.76 |
| $C18:1^{\Delta 11}$ | 0.28 ± 0.24 | 0.61 ± 0.01 | 0.67 ± 0.03 |
| $C18:2^{\Delta 9, 12}$ | 10.26 ± 0.96 | 12.39 ± 1.33 | 5.20 ± 0.32 |
| $C18:3^{\Delta 9, 12, 15}$ | 63.90 ± 1.18 | 55.70 ± 1.26 | 55.65 ± 1.23 |
| C20:0 | 0.09 ± 0.15 | 0.19 ± 0.16 | 0.08 ± 0.14 |
| $C20:1^{\Delta 11}$ | 0 | 0 | 0 |
| C22:0 | 0 | 0.17 ± 0.15 | 0 |
| C24:0 | 0.09 ± 0.15 | 0.19 ± 0.16 | 0.09 ± 0.16 |

TABLE 28

Fatty acid profiles of total lipids isolated from triplicate
Nicotiana benthamiana leaf tissue transiently transformed with
35S:V2, 35S:MGAT2, 35S:DGAT1, 35S:WRI1 and 35S:FAD2-hpRNAi.

| Fatty acid | V2 | V2, WRI1, MGAT2, DGAT1 | V2, WRI1, MGAT2, DGAT1, FAD2-hpRNAi |
|---|---|---|---|
| $C14:1^{\Delta 9}$ | 0.53 ± 0.08 | 0.27 ± 0.02 | 0.26 ± 0.02 |
| C16:0 | 16.00 ± 1.05 | 19.70 ± 0.63 | 17.30 ± 0.72 |
| $C16:1^{\Delta 9}$ | 2.02 ± 0.62 | 0.24 ± 0.02 | 0.28 ± 0.02 |
| C18:0 | 3.75 ± 0.25 | 4.33 ± 0.09 | 4.17 ± 0.03 |
| $C18:1^{\Delta 9}$ | 11.12 ± 6.77 | 23.32 ± 4.09 | 40.37 ± 2.24 |
| $C18:1^{\Delta 11}$ | 0.46 ± 0.08 | 0.69 ± 0.03 | 0.75 ± 0.01 |
| $C18:2^{\Delta 9, 12}$ | 11.14 ± 0.83 | 17.28 ± 2.34 | 4.56 ± 0.29 |
| $C18:3^{\Delta 9, 12, 15}$ | 53.27 ± 7.34 | 32.43 ± 1.49 | 30.43 ± 1.34 |
| C20:0 | 0.51 ± 0.16 | 0.93 ± 0.05 | 0.92 ± 0.03 |
| $C20:1^{\Delta 11}$ | 0 | 0.26 ± 0.03 | 0.40 ± 0.02 |
| C22:0 | 0.83 ± 0.24 | 0.36 ± 0.06 | 0.37 ± 0.04 |
| C24:0 | 0.38 ± 0.09 | 0.19 ± 0.03 | 0.20 ± 0.02 |

TABLE 29

Fatty acid composition of TAG, Polar lipids and total lipids in infiltrated N. benthamiana leaf samples.

| | TAG | | Polar lipids | | Total lipids | |
|---|---|---|---|---|---|---|
| | V2 + MGAT2 + DGAT1 + WRI1 + Oleosin | V2 + MGAT2 + DGAT1 + WRI1 + Oleosin + FAD2-hpRNAi | V2 + MGAT2 + DGAT1 + WRI1 + Oleosin | V2 + MGAT2 + DGAT1 + WRI1 + Oleosin + FAD2-hpRNAi | V2 + MGAT2 + DGAT1 + WRI1 + Oleosin | V2 + MGAT2 + DGAT1 + WRI1 + Oleosin + FAD2-hpRNAi |
|---|---|---|---|---|---|---|
| C14:0 | 0.00 | 0.00 | 0.00 | 0.00 | 0.06 ± 0.03 | 0.02 ± 0.03 |
| $C14:1^{\Delta 9}$ | 0.00 | 0.00 | 0.05 ± 0.12 | 0.00 | 0.24 ± 0.03 | 0.19 ± 0.10 |
| C16:0 | 19.63 ± 0.53 | 16.95 ± 1.13 | 15.85 ± 1.17 | 16.42 ± 2.11 | 16.88 ± 0.92 | 15.45 ± 1.24 |
| $C16:1^{\Delta 13t}$ | 0.00 | 0.15 ± 0.16 | 2.31 ± 0.38 | 1.61 ± 0.85 | 1.03 ± 0.23 | 0.85 ± 0.23 |
| $C16:3^{\Delta 7,12,15}$ | 0.00 | 0.00 | 7.54 ± 0.40 | 7.42 ± 0.59 | 3.25 ± 0.47 | 2.79 ± 0.43 |
| C18:0 | 6.64 ± 1.35 | 6.99 ± 0.43 | 2.88 ± 0.13 | 2.41 ± 1.21 | 5.36 ± 0.15 | 5.40 ± 0.18 |
| $C18:1^{\Delta 9}$ | 29.45 ± 3.65 | 53.97 ± 1.51 | 8.56 ± 2.04 | 19.68 ± 1.32 | 20.59 ± 3.52 | 39.27 ± 2.28 |
| $C18:1^{\Delta 11}$ | 0.59 ± 0.29 | 0.68 ± 0.34 | 0.45 ± 0.22 | 0.40 ± 0.31 | 0.59 ± 0.03 | 0.66 ± 0.05 |
| $C18:2^{\Delta 9,12}$ | 23.47 ± 1.18 | 5.29 ± 0.37 | 13.13 ± 2.33 | 4.72 ± 2.33 | 18.35 ± 0.70 | 5.56 ± 0.28 |
| $C18:3^{\Delta 9,12,15}$ | 18.32 ± 5.48 | 12.84 ± 0.60 | 49.04 ± 2.78 | 47.22 ± 5.40 | 30.03 ± 3.51 | 26.28 ± 3.07 |
| C20:0 | 1.12 ± 0.56 | 1.56 ± 0.04 | 0.19 ± 0.21 | 0.11 ± 0.17 | 0.88 ± 0.06 | 1.03 ± 0.07 |
| $C20:1^{\Delta 11}$ | 0.00 | 0.20 ± 0.22 | 0.00 | 0.00 | 0.08 ± 0.08 | 0.22 ± 0.11 |
| C22:0 | 0.57 ± 0.28 | 0.81 ± 0.07 | 0.00 | 0.00 | 0.54 ± 0.05 | 0.61 ± 0.07 |
| C22:1 | 0.00 | 0.00 | 0.00 | 0.00 | 0.50 ± 0.03 | 0.22 ± 0.24 |
| C22:2n6 | 0.00 | 0.00 | 0.00 | 0.00 | 0.80 ± 0.14 | 0.77 ± 0.13 |
| C24:0 | 0.21 ± 0.32 | 0.57 ± 0.29 | 0.00 | 0.00 | 0.42 ± 0.01 | 0.48 ± 0.03 |
| C24:1 | 0.00 | 0.00 | 0.00 | 0.00 | 0.42 ± 0.05 | 0.18 ± 0.2 |

Example 18

Expression of *Mus musculus* MGAT1 and MGAT2 in *Nicotiana Benthamiana* Cells by Stable Transformation Constitutive Expression in *N. benthamiana*

The enzyme activity of the *M. musculus* MGAT1 and MGAT2 was demonstrated in *Nicotiana benthamiana*. The chimeric vectors 35S:Musmu-MGAT1 and 35S:Musmu-MGAT2 were introduced into *A. tumefaciens* strain AGL1 via standard electroporation procedure and grown on solid LB media supplemented with kanamycin (50 mg/L) and rifampicin (25 mg/L) and incubated at 28° C. for two days. A single colony was used to initiate fresh culture. Following 48 hours culturing with vigorous aeration, the cells were collected by centrifugation at 2,000×g and the supernatant were removed. The cells were resuspended in a new solution containing 50% LB and 50% MS medium at the density of $OD_{600}=0.5$. Leaf samples of *Nicotiana benthamiana* plants grown aseptically in vitro were excised and cut into square sections around 0.5-1 $cm^2$ in size with a sharp scalpel while immersed in the *A. tumefaciens* solution. The wounded *N. benthamiana* leaf pieces submerged in *A. tumefaciens* were allowed to stand at room temperature for 10 min prior to being blotted dry on a sterile filter paper and transferred onto MS plates without supplement. Following a co-cultivation period of two days at 24° C., the explants were washed three times with sterile liquid MS medium, and finally blot dry with sterile filter paper and placed on the selective agar-solidified MS medium supplemented with 1.0 mg/L bencylaminopurine (BAP), 0.25 mg/L indoleacetic acid (IAA), 50 mg/L kanamycin and 250 mg/L cefotaxime and incubated at 24° C. for two weeks to allow for shoot development from the transformed *N. benthamiana* leaf discs. To establish in vitro transgenic plants, healthy green shoots were cut off and transferred onto a new 200 mL tissue culture pots containing agar-solidified MS medium supplemented with 25 mg/L IAA and 50 mg/L kanamycin and 250 mg/L cefotaxime.

Expression of the MGAT1 and MGAT2 transgenes was determined by Real-Time PCR. Highly-expressing lines were selected and their seed harvested. This seed was planted directly onto soil and the segregating population of seedlings harvested after four weeks. Highly-expressing events were selected and seed produced by these planted out directly onto soil to result in a segregating population of 30 seedlings. After three weeks leaf discs were taken from each seedling for DNA extraction and subsequent PCR to determine which lines were transgenic and which were null for the transgene. The population was then harvested with the entire aerial tissue from each seedling cleaned of soil and freeze-dried. The dry weight of each sample was recorded and total lipids isolated. The TAG in these total lipid samples was quantified by TLC-FID and the ratio of TAG to an internal standard (DAGE) in each sample determined (FIG. 14). The average level of TAG in the transgenic seedlings of 35S:Musmu-MGAT2 line 3347-19 was found to be 4.1-fold higher than the average level of TAG in the null seedlings. The event with the largest increase in TAG had 7.3-fold higher TAG than the average of the null events.

Constitutive Expression in *A. thaliana*

The enzyme activity of the *M. musculus* MGAT1 and MGAT2 was demonstrated in *A. thaliana*. The chimeric vectors 35S:Musmu-MGAT1 and 35S:Musmu-MGAT2 along with the empty vector control pORE04 were transformed in *A. thaliana* by the floral dip method and seed from primary transformants selected on kanamycin media. The T2 seed from these T1 plants was harvested and TFA of the seeds from each plant determined (FIG. 15). The average mg TFA/g seed was found to be 139±13 for the control pORE04 lines with median 136.0, 152±14 for the 35S:MGAT1 lines with median 155.1 and 155±11 for the 35S:MGAT2 lines with median 154.7. This represented an average TFA increase compared to the control of 9.7% for 35S:MGAT1 and 12.1% for 35S:MGAT2.

Example 19

Additional Genes

Further Increases in Oil

Additional genes are tested alongside the combinations described above to determine whether further oil increases can be achieved. These include the following *Arabidopsis* genes: AT4G02280, Sucrose synthase SUS3; AT2G36190, Invertase CWINV4; AT3G13790, Invertase CWINV1; AT1G61800, Glucose 6 phosphate:phosphate translocator GPT2; AT5 G33320, Phosphoenolpyruvate transporter PPT1; AT4G15530, Pyruvate orthophosphate dikinase Plastid-PPDK; AT5G52920, Pyruvate kinase pPK-β1. The genes coding for these enzymes are synthesised and cloned into the constitutive binary expression vector pJP3343 as EcoRI fragments for testing in *N. benthamiana*.

When a number of genes were added to the combination of WRI1, DGAT1, MGAT2 and oleosin and expressed in *N. benthamiana* leaves, no additional increase in the level of TAG was observed, namely for: safflower PDAT, *Arabidopsis thaliana* PDAT1, *Arabidopsis thaliana* DGAT2, *Arabidopsis thaliana* caleosin, peanut oleosin, *Arabidopsis thaliana* haemoglobin 2, *Homo sapiens* iPLAh, *Arabidopsis thaliana* GPAT4, *E. coli* G3P dehydrogenase, yeast G3P dehydrogenase, castor LPAAT2, *Arabidopsis thaliana* beta-fructofuranosidase (ATBFRUCT1, NM_112232), *Arabidopsis thaliana* beta-fructofuranosidase (cwINV4, NM_129177), indicating that none of these enzyme activities were rate limiting in *N. benthamiana* leaves when expressed transiently. This does not indicate that they will have no effect in stably-transformed plants, such as in seed, or in other organisms.

Further additional genes are tested for additive or synergistic oil increase activity. These include the following *Arabidopsis thaliana* gene models or their encoded proteins, and homologues from other species, which are grouped by putative function and have previously been shown to be upregulated in tissues with increased oil content. Genes/proteins involved in sucrose degradation: AT1G73370, AT3G43190, AT4G02280, AT5G20830, AT5G37180, AT5G49190, AT2G36190, AT3G13784, AT3G13790, AT3G52600. Genes/proteins involved in the oxidative pentose phosphate pathway: AT3G27300, AT5G40760, AT1G09420, AT1G24280, AT5G13110, AT5G35790, AT3 G02360, AT5G41670, AT1G64190, AT2G45290, AT3 G60750, AT1G12230, AT5G13420, AT1G13700, AT5G24410, AT5G24420, AT5G24400, AT1G63290, AT3G01850, AT5G61410, AT1G71100, AT2G01290, AT3G04790, AT5G44520, AT4G26270, AT4G29220, AT4G32840, AT5G47810, AT5G56630, AT2G22480, AT5G61580, AT1G18270, AT2G36460, AT3 G52930, AT4G26530, AT2G01140, AT2G21330, AT4G38970, AT3G55440, AT2G21170. Genes/proteins involved in glycolysis: AT1G13440, AT3G04120, AT1G16300, AT1G79530, AT1G79550, AT3G45090, AT5G60760, AT1G56190, AT3G12780, AT5G61450, AT1G09780, AT3 G08590, AT3G30841, AT4G09520, AT1G22170, AT1G78050, AT2G36530, AT1G74030. Genes/ proteins which function as plastid transporters: AT1G61800, AT5G16150, AT5G33320, AT5G46110, AT4G15530, AT2G36580, AT3G52990, AT3G55650, AT3G55810, AT4G26390, AT5G08570, AT5G56350, AT5G63680, AT1G32440, AT3G22960, AT3 G49160, AT5G52920. Genes/proteins involved in malate and pyruvate metabolism: AT1G04410, AT5G43330, AT5G56720, AT1G53240, AT3G15020, AT2G22780, AT5G09660, AT3G47520, AT5G58330, AT2G19900, AT5G11670, AT5G25880, AT2G13560, AT4G00570.

Constructs are prepared which include sequences encoding these candidate proteins, which are infiltrated into *N. benthamiana* leaves as in previous experiments, and the fatty acid content and composition analysed. Genes which aid in increasing non-polar lipid content are combined with the other genes as described above, principally those encoding MGAT, Wri1, DGAT1 and an Oleosin, and used to transform plant cells.

Increases in Unusual Fatty Acids

Additional genes are tested alongside the combinations described above to determine whether increases in unusual fatty acids can be achieved. These include the following genes (provided are the GenBank Accession Nos.) which are grouped by putative function and homologues from other species. Delta-12 acetylenases ABC00769, CAA76158, AAO38036, AAO38032; Delta-12 conjugases AAG42259, AAG42260, AAN87574; Delta-12 desaturases P46313, ABS18716, AAS57577, AAL61825, AAF04093, AAF04094; Delta-12 epoxygenases XP_001840127, CAA76156, AAR23815; Delta-12 hydroxylases ACF37070, AAC32755, ABQ01458, AAC49010; and Delta-12 P450 enzymes such as AF406732.

Constructs are prepared which include sequences encoding these candidate proteins, which are infiltrated into *N. benthamiana* leaves as in previous experiments, and the fatty acid content and composition analysed. The nucleotide sequences of the coding regions may be codon-optimised for the host species of interest. Genes which aid in increasing unusual fatty acid content are combined with the other genes as described above, principally those encoding MGAT, WRI1, DGAT1 and an Oleosin, and used to transform plant cells.

Example 20

Stable Transformation of Plants Including *Nicotiana tabacum* with Combinations of Oil Increase Genes An existing binary expression vector, pORE04+11ABG-BEC (U.S. Provisional Patent Application No. 61/660,392), which contained a double enhancer-region 35S promoter expressing the NPTII kanamycin resistance gene and three gene expression cassettes, was used as a starting vector to prepare several contructs each containing a combination of genes for sstable transformation of plants. This vector was modified by exchanging the expressed genes with oil increase genes, as follows. pORE04+11ABGBEC was first modified by inserting an intron-interrupted sesame oleosin gene, flanked by NotI sites, from the vector pRSh1-PSP1 into the pORE04+11ABGBEC NotI sites to generate pJP3500. pJP3500 was then modified by inserting a codon-optimised DNA fragment encoding the *A. thaliana* WRL1 gene into the EcoRI sites to generate pJP3501. pJP3501 was further modified by inserting a DNA fragment encoding the wild-type *A. thaliana* DGAT1 coding region, flanked by AsiSI sites, into the AsiSI sites to generate pJP3502 (SEQ ID NO:409). A final modification was made by inserting another expression cassette, consisting of a double enhancer-region 35S promoter expressing a coding region encoding the *M. musculus* MGAT2, as a StuI-ZraI fragment into the SfoI site of pJP3502 to generate pJP3503 (SEQ ID NO:410). The MGAT2 expression cassette was excised from pJP3347 at the StuI+ZraI sites. pJP3502 and pJP3503 were both used to stably transform *N. tabacum* as described below. By these constructions, pJP3502 contained the *A. thaliana* WRL1 and DGAT1 coding regions driven by the *A. thaliana* Rubisco small subunit promoter (SSU) and double enhancer-region 35S promoter, respectively, as well as a SSU:sesame oleosin cassette. The T-DNA region of this construct is shown schematically in FIG. 16. The vector pJP3503 additionally contained the e35S::MGAT2 cassette. This construct is shown schematically in FIG. 17. The nucleotide sequence of the T-DNA region of the construct pJP3503 is given as SEQ ID NO:412.

Stable Transformation of *Nicotiana tabacum* with Combinations of Genes

The binary vectors pJP3502 and pJP3503 were separately introduced into the *A. tumefaciens* strain AGL1 by a standard electroporation procedure. Transformed cells were selected and grown on LB-agar supplemented with kanamycin (50 mg/l) and rifampicin (25 mg/l) and incubated at 28° C. for two days. A single colony of each was used to initiate fresh cultures in LB broth. Following 48 hours incubation with vigorous aeration, the cells were collected by centrifugation at 2,000 g and the supernatant was removed. The cells were resuspended at the density of $OD_{600}$=0.5 in fresh medium consisting of 50% LB and 50% MS medium.

Leaf samples of *N. tabacum* cultivar W38 grown aseptically in vitro were excised with a scalpel and cut into pieces of about 0.5-1 $cm^2$ in size while immersed in the *A. tumefaciens* suspensions. The cut leaf pieces were left in the *A. tumefaciens* suspensions at room temperature for 15 minutes prior to being blotted dry on a sterile filter paper and transferred onto MS plates without antibiotic supplement. Following a co-cultivation period of two days at 24° C., the explants were washed three times with sterile, liquid MS medium, then blotted dry with sterile filter paper and placed on the selective MS agar supplemented with 1.0 mg/L benzylaminopurine (BAP), 0.5 mg/L indoleacetic acid (IAA), 100 mg/L kanamycin and 200 mg/L cefotaxime. The plates were incubated at 24° C. for two weeks to allow for shoot development from the transformed *N. tabacum* leaf pieces.

To establish rooted transgenic plants in vitro, healthy green shoots were cut off and transferred to MS agar medium supplemented with 25 µg/L IAA, 100 mg/L kanamycin and 200 mg/L cefotaxime. After roots had developed, individual plants were transferred to soil and grown in the glasshouse. Leaf samples were harvested at different stages of plant development including before and during flowering. Total fatty acids, polar lipids and TAG were quantified and their fatty acid profiles determined by TLC/GC as described in Example 1.

Analysis of pJP3503 Transformants

For the transformation with pJP3503 ("4-gene construct"), leaf samples of about 1 $cm^2$ were taken from 30 primary transformants prior to flower buds forming and TAG levels in the samples were quantified by Iatroscan. Seven plants were selected for further analysis, of which five displaying increased leaf oil levels and two exhibiting oil levels essentially the same as wild-type plants. Freeze-dried leaf samples from these plants were analysed for total lipid content and TAG content and fatty acid composition by TLC and GC. Transformed plants numbered 4 and 29 were found to have considerably increased levels of leaf oil compared to the wild type, while plant number 21 exhibited the lowest TAG levels at essentially wild-type levels (Table 30). Plants numbered 11, 15 and 27 had intermediate levels of leaf oil. Oleic acid levels in TAG were found to be inversely correlated to the TAG yields, consistent with the results of the earlier transient expression experiments in N. benthamiana.

Figure 18:
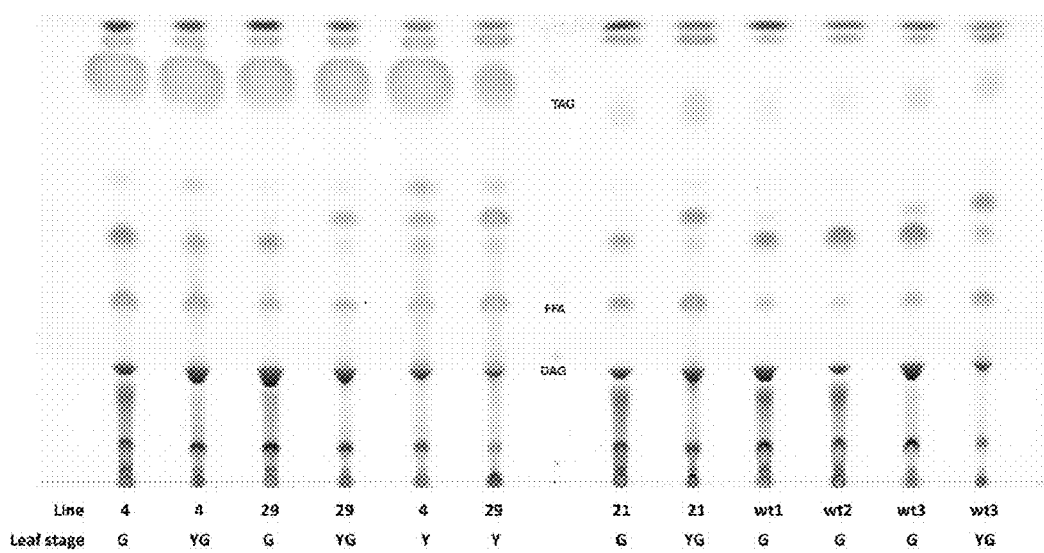

In the transformed plants numbered 4 and 29, leaf oil content (as a percentage of dry weight) was found to increase considerably at the time of flowering (Table 31). From the data in Table 31, the increase was at least 1.7- and 2.4-fold for plants 4 and 29, respectively. No such change was observed for plant 21 which had TAG levels similar to the wild-type control. Oleic acid levels in the TAG fractions isolated from each sample followed a similar pattern. This fatty acid accumulated up to 22.1% of the fatty acid in TAG from plants 4 and 29, a 17-18-fold increase compared to plant 21 and the wild-type. The increase in oleic acid was accompanied by increased linoleic acid and palmitic acid levels while α-linolenic acid levels dropped 8-fold compared to in plant 21 and the wild-type control. Unlike TAG, polar lipid levels decreased slightly at the flowering stage in the three lines (Table 32). Changes in C18 monounsaturated and polyunsaturated fatty acid levels in the polar lipid fractions of the three lines were similar to the shifts in their TAG composition although the changes in oleic acid and linoleic acid were less marked. Significant increases in total leaf lipids were observed for lines 4 and 29 during flowering with levels reaching more than 10% of dry weight (Table 33). Total leaf lipid levels in plant 21 before and during flowering were similar to levels observed in wild-type plants at similar stages (Tables 33 and 35). Changes in the total lipid fatty acid composition of all three plants were similar to the respective TAG fatty acid compositions. Leaf oil in plant 4 during seed setting was found to be further elevated at the onset of leaf chlorosis. The highest leaf TAG levels detected at this stage corresponded to a 65-fold increase compared to similar aged leaves in plant 21 during seed setting and a 130-fold increase compared to similar leaves of flowering wild-type plants (Table 34; FIG. 18).

The increased TAG in this plant coincided with elevated oleic acid levels. Unlike plant 4, leaf TAG levels in the other two primary transformants and wild-type tobacco did not increase, or only marginally increased, after flowering and during chlorosis. The lower leaves of plants 4 and 29 exhibited reduced TAG levels upon senescence. In all plants, linoleic acid levels dropped while α-linolenic acid levels were increased with progressing leaf age.

Consistent with the increased TAG levels, total lipid levels in leaves of plants 4 and 29 during seed setting were further elevated compared to similar leaves of both plants during flowering (Tables 33 and 35). The highest total lipid level detected in plant 4 on a dry weight basis was 15.8%, equivalent to a 7.6- and 11.2-fold increase compared to similar leaves of plant 21 and wild-type plants, respectively. Whilst the fatty acid composition of total lipid in the leaves of the wild type plant and plant 21 were similar, significant differences were observed in plants 4 and 29. These changes mirrored those found in TAG of both primary transformants.

Intriguingly, leaves of plants 4 and 29 before and during seed setting were characterized by a glossy surface, providing a phenotypic change that can serve as a phenotype that is easily scored visually, which could aid the timing of harvest for maximal oil content.

In summary, leaves of plants 4 and 29 rapidly accumulated TAG during flowering up till seed setting. At the latter stage, the majority of leaves exhibited TAG levels between 7% and 13% on a dry weight basis, compared to 0.1%-0.2% for line 21. These observed TAG levels and total lipid levels far exceed the levels achieved by Andrianov et al., (2010) who reported up to a maximum of 5.8% and 6.8% TAG in leaves of N. tabacum upon constitutive expression of the A. thaliana DGAT1 and inducible expression of the A. thaliana LEC2 genes.

TABLE 30

Percentage TAG (% weight of leaf dry weight) and oleic acid levels (% of total fatty acids) in the TAG isolated from leaves of selected primary tobacco plants transformed with pJP3503

| Plant No. | % TAG (DW) | % C18:1$^{\Delta 9}$ | Development stage of plant |
| --- | --- | --- | --- |
| Wild type | 0.06 | 2.3 | Budding |
| Wild type | 0.1 | 1.3 | Flowering |
| 3 | 0.05 | 1.5 | Budding |
| 4 | 1.29 | 10.2 | Budding |
| 11 | 0.21 | 7.4 | Flowering |
| 15 | 0.23 | 4.5 | No buds |
| 21 | 0.01 | 1.9 | No buds |
| 27 | 0.19 | 3.3 | Budding |
| 29 | 1.15 | 10.4 | No buds |

TABLE 31

TAG levels (% weight of leaf dry weight) and fatty acid composition of TAG isolated from wild-type and three selected tobacco plants transformed with pJP3503, before and during flowering. The data shown are averages and standard deviations of 2-3 independent repeats.

| | Before flowering | | | | Flowering | | | |
| --- | --- | --- | --- | --- | --- | --- | --- | --- |
| | Wild type | Plant 21 | Plant 4 | Plant 29 | Wild type | Plant 21 | Plant 4 | Plant 29 |
| %/leaf DW | 0.1 | 0.0 | 3.1 ± 0.3 | 4.1 ± 0.3 | 0.1 | 0.1 ± 0.0 | 7.3 ± 0.3 | 6.9 ± 0.5 |
| C14:0 | 0.6 | 0.6 ± 0.2 | 0.1 ± 0.0 | 0.2 ± 0.0 | 0.5 | 0.4 ± 0.0 | 0.1 ± 0.0 | 0.1 ± 0.0 |
| C16:0 | 9.1 | 15.9 ± 0.3 | 42.0 ± 0.5 | 34.9 ± 0.7 | 7.5 | 15.0 ± 0.7 | 33.1 ± 1.0 | 24.8 ± 1.4 |
| C16:1$^{\Delta 3t}$ | 0.0 | 0.4 ± 0.1 | 0.1 ± 0.0 | 0.2 ± 0.0 | 0.4 | 0.2 ± 0.0 | 0.1 ± 0.0 | 0.2 ± 0.0 |
| C16:1$^{\Delta 9}$ | 0.3 | 0.6 ± 0.0 | 3.3 ± 0.2 | 1.5 ± 0.1 | 0.3 | 0.6 ± 0.0 | 3.3 ± 0.2 | 1.2 ± 0.1 |
| C16:3$^{\Delta 7,12,15}$ | 3.7 | 0.8 ± 0.1 | 0.1 ± 0.0 | 0.2 ± 0.0 | 3.6 | 0.8 ± 0.1 | 0.1 ± 0.0 | 0.2 ± 0.0 |
| C18:0 | 3.2 | 4.6 ± 0.4 | 3.0 ± 0.1 | 5.6 ± 0.3 | 2.4 | 3.4 ± 0.0 | 3.3 ± 0.1 | 4.6 ± 0.1 |
| C18:1$^{\Delta 9}$ | 2.3 | 1.2 ± 0.2 | 10.6 ± 0.3 | 10.6 ± 0.2 | 1.3 | 1.2 ± 0.2 | 19.1 ± 1.8 | 22.1 ± 2.7 |
| C18:1$^{\Delta 11}$ | 0.1 | 0.1 ± 0.0 | 2.2 ± 0.2 | 1.2 ± 0.1 | 0.1 | 0.1 ± 0.0 | 2.1 ± 0.0 | 0.9 ± 0.0 |
| C18:2$^{\Delta 9,12}$ | 26.9 | 20.4 ± 1.1 | 20.7 ± 0.7 | 30.0 ± 1.0 | 23.7 | 19.5 ± 0.8 | 25.3 ± 0.6 | 34.7 ± 1.0 |
| C18:3$^{\Delta 9,12,15}$ | 52.6 | 54.0 ± 0.8 | 15.9 ± 0.5 | 11.5 ± 1.3 | 59.3 | 57.5 ± 0.4 | 10.8 ± 0.5 | 7.1 ± 0.6 |
| C20:0 | 0.3 | 0.6 ± 0.0 | 1.0 ± 0.0 | 2.1 ± 0.2 | 0.3 | 0.4 ± 0.0 | 1.3 ± 0.0 | 2.0 ± 0.1 |
| C20:1$^{\Delta 11}$ | 0.1 | 0.0 | 0.0 | 0.2 ± 0.1 | 0.1 | 0.1 ± 0.0 | 0.1 ± 0.0 | 0.3 ± 0.0 |
| C20:2$^{\Delta 11,14}$ | 0.2 | 0.2 ± 0.0 | 0.0 | 0.1 ± 0.0 | 0.2 | 0.3 ± 0.0 | 0.0 | 0.1 ± 0.0 |

TABLE 31-continued

TAG levels (% weight of leaf dry weight) and fatty acid composition of TAG isolated from wild-type and three selected tobacco plants transformed with pJP3503, before and during flowering. The data shown are averages and standard deviations of 2-3 independent repeats.

|  | Before flowering | | | | Flowering | | | |
|---|---|---|---|---|---|---|---|---|
|  | Wild type | Plant 21 | Plant 4 | Plant 29 | Wild type | Plant 21 | Plant 4 | Plant 29 |
| $C20:3^{\Delta 11,14,17}$ | 0.2 | 0.2 ± 0.0 | 0.0 | 0.0 | 0.1 | 0.2 ± 0.0 | 0.0 | 0.0 |
| C22:0 | 0.1 | 0.2 ± 0.0 | 0.5 ± 0.0 | 1.0 ± 0.1 | 0.0 | 0.2 ± 0.0 | 0.7 ± 0.0 | 1.0 ± 0.0 |
| C24:0 | 0.4 | 0.1 ± 0.1 | 0.4 ± 0.0 | 0.9 ± 0.1 | 0.3 | 0.1 ± 0.0 | 0.5 ± 0.0 | 0.7 ± 0.1 |

TABLE 32

Polar lipid levels (% weight of leaf dry weight) and fatty acid composition of polar lipids of leaf tissue from selected tobacco plants transformed with pJP3503, before and during flowering. Data shown are the average and standard deviations of 2-3 independent repeats, except for plant 21 (before flowering).

|  | Before flowering | | | Flowering | | |
|---|---|---|---|---|---|---|
|  | Plant 21 | Plant 4 | Plant 29 | Plant 21 | Plant 4 | Plant 29 |
| %/leaf DW | 2.0 | 3.3 ± 0.4 | 2.5 ± 0.4 | 1.7 ± 0.0 | 2.4 ± 0.0 | 1.7 ± 0.1 |
| C14:0 | 0.0 | 0.0 | 0.0 | 0.0 | 0.0 | 0.0 |
| C16:0 | 12.0 | 18.7 ± 0.6 | 12.7 ± 0.4 | 12.7 ± 0.0 | 16.2 ± 0.2 | 11.8 ± 0.2 |
| $C16:1^{\Delta 3t}$ | 1.6 | 0.5 ± 0.1 | 1.4 ± 0.1 | 1.4 ± 0.0 | 1.1 ± 0.2 | 1.4 ± 0.1 |
| $C16:1^{\Delta 9}$ | 0.1 | 2.0 ± 0.1 | 0.7 ± 0.1 | 0.1 ± 0.0 | 1.8 ± 0.1 | 0.5 ± 0.0 |
| $C16:3^{\Delta 7,12,15}$ | 7.5 | 2.4 ± 0.2 | 3.8 ± 0.1 | 6.3 ± 0.0 | 1.0 ± 0.1 | 3.7 ± 0.3 |
| C18:0 | 2.1 | 1.1 ± 0.0 | 0.9 ± 0.1 | 2.5 ± 0.1 | 1.3 ± 0.0 | 1.4 ± 0.0 |
| $C18:1^{\Delta 9}$ | 1.1 | 5.6 ± 0.5 | 4.1 ± 0.0 | 1.0 ± 0.1 | 11.9 ± 1.1 | 9.2 ± 0.9 |
| $C18:1^{\Delta 11}$ | 0.1 | 2.2 ± 0.1 | 1.0 ± 0.1 | 0.1 ± 0.0 | 2.1 ± 0.1 | 0.6 ± 0.0 |
| $C18:2^{\Delta 9,12}$ | 12.5 | 19.8 ± 1.0 | 19.7 ± 1.4 | 13.6 ± 0.1 | 27.6 ± 0.6 | 28.8 ± 0.5 |
| $C18:3^{\Delta 9,12,15}$ | 62.3 | 46.8 ± 0.6 | 55.1 ± 0.8 | 61.3 ± 0.1 | 36.0 ± 1.1 | 41.6 ± 0.6 |
| C20:0 | 0.3 | 0.3 ± 0.0 | 0.2 ± 0.0 | 0.3 ± 0.0 | 0.4 ± 0.0 | 0.4 ± 0.0 |
| $C20:1^{\Delta 11}$ | 0.0 | 0.0 | 0.0 | 0.0 | 0.0 | 0.0 |
| $C20:2^{\Delta 11,14}$ | 0.1 | 0.0 | 0.0 | 0.1 ± 0.0 | 0.0 | 0.0 |
| $C20:3^{\Delta 11,14,17}$ | 0.1 | 0.0 | 0.0 | 0.1 ± 0.0 | 0.0 | 0.0 |
| C22:0 | 0.2 | 0.2 ± 0.0 | 0.2 ± 0.0 | 0.2 ± 0.0 | 0.3 ± 0.0 | 0.3 ± 0.0 |
| C24:0 | 0.2 | 0.2 ± 0.0 | 0.3 ± 0.0 | 0.2 ± 0.0 | 0.3 ± 0.0 | 0.3 ± 0.0 |

TABLE 33

Total lipid levels (% weight of leaf dry weight) and fatty acid composition of total lipids in leaves from tobacco plants transformed with pJP3503, just before and during flowering. Data shown are the average of 2-3 leaf samples.

|  | Before flowering | | | Flowering | | |
|---|---|---|---|---|---|---|
|  | Plant 21 | Plant 4 | Plant 29 | Plant 21 | Plant 4 | Plant 29 |
| %/leaf DW | 2.4 ± 0.2 | 6.9 ± 0.5 | 4.9 ± 1.1 | 2.0 ± 0.1 | 9.8 ± 0.3 | 8.8 ± 0.3 |
| C14:0 | 0.1 ± 0.0 | 0.1 ± 0.0 | 0.1 ± 0.0 | 0.1 ± 0.0 | 0.1 ± 0.0 | 0.1 ± 0.0 |
| C16:0 | 12.1 ± 0.1 | 27.6 ± 1.2 | 20.7 ± 0.6 | 12.7 ± 0.1 | 26.9 ± 0.9 | 20.2 ± 1.2 |
| $C16:1^{\Delta 3t}$ | 2.1 ± 0.2 | 0.4 ± 0.0 | 0.9 ± 0.1 | 2.7 ± 0.4 | 0.8 ± 0.1 | 0.7 ± 0.1 |
| $C16:1^{\Delta 9}$ | 0.0 | 2.6 ± 0.2 | 1.0 ± 0.1 | 0.0 | 2.9 ± 0.1 | 1.0 ± 0.0 |
| $C16:3^{\Delta 7,12,15}$ | 6.9 ± 0.3 | 1.3 ± 0.1 | 2.1 ± 0.1 | 5.6 ± 0.2 | 0.4 ± 0.0 | 0.9 ± 0.1 |
| C18:0 | 2.2 ± 0.1 | 1.9 ± 0.0 | 2.8 ± 0.1 | 2.6 ± 0.1 | 2.6 ± 0.1 | 3.6 ± 0.1 |
| $C18:1^{\Delta 9}$ | 1.1 ± 0.2 | 7.5 ± 0.5 | 6.6 ± 0.0 | 1.1 ± 0.2 | 16.2 ± 1.5 | 17.8 ± 2.0 |
| $C18:1^{\Delta 11}$ | 0.2 ± 0.0 | 2.1 ± 0.1 | 1.1 ± 0.1 | 0.2 ± 0.0 | 2.0 ± 0.0 | 0.8 ± 0.0 |
| $C18:2^{\Delta 9,12}$ | 13.8 ± 1.5 | 21.4 ± 0.7 | 26.5 ± 1.6 | 14.1 ± 0.5 | 27.3 ± 0.4 | 35.9 ± 0.5 |
| $C18:3^{\Delta 9,12,15}$ | 60.6 ± 1.4 | 33.6 ± 1.5 | 36.0 ± 1.0 | 58.5 ± 1.2 | 18.3 ± 0.5 | 15.5 ± 0.6 |
| C20:0 | 0.3 ± 0.0 | 0.7 ± 0.0 | 1.0 ± 0.1 | 0.3 ± 0.0 | 1.0 ± 0.0 | 1.5 ± 0.0 |
| $C20:1^{\Delta 11}$ | 0.0 | 0.0 | 0.1 ± 0.0 | 0.0 | 0.1 ± 0.0 | 0.3 ± 0.0 |
| $C20:2^{\Delta 11,14}$ | 0.1 ± 0.0 | 0.0 | 0.1 ± 0.0 | 0.2 ± 0.0 | 0.0 | 0.0 |
| $C20:3^{\Delta 11,14,17}$ | 0.1 ± 0.0 | 0.0 | 0.0 | 0.3 ± 0.0 | 0.6 ± 0.0 | 0.8 ± 0.0 |
| C22:0 | 0.2 ± 0.0 | 0.3 ± 0.0 | 0.5 ± 0.1 | 1.3 ± 0.1 | 0.3 ± 0.0 | 0.2 ± 0.0 |
| C24:0 | 0.2 ± 0.0 | 0.3 ± 0.0 | 0.5 ± 0.0 | 0.3 ± 0.0 | 0.5 ± 0.0 | 0.6 ± 0.0 |

TABLE 34

TAG levels (% weight of leaf dry weight) and fatty acid composition of TAG isolated from different aged leaves, post flowering, of three selected tobacco plants transformed with pJP3503.

| | Plant:[a] | | | | | | | | | |
|---|---|---|---|---|---|---|---|---|---|---|
| | Wild type | Plant 21 | | Plant 4 | | | Plant 29 | | | |
| | | | | Leaf stage[b] | | | | | | |
| | G | YG | G | YG | G | YG | Y | G | YG | Y[c] |
| %/leaf DW | 0.1 | 0.1 | 0.1 | 0.2 | 9.5 | 13.0 | 10.7 | 7.0 | 7.1 | 2.1 |
| C14:0 | 0.5 | 0.3 | 0.4 | 0.3 | 0.2 | 0.1 | 0.1 | 0.2 | 0.2 | 0.3 |
| C16:0 | 7.5 | 14.8 | 8.9 | 14.9 | 31.1 | 33.3 | 38.0 | 25.7 | 33.0 | 38.5 |
| C16:1$^{\Delta 3t}$ | 0.4 | 0.3 | 0.3 | 0.2 | 0.1 | 0.1 | 0.1 | 0.2 | 0.2 | 0.3 |
| C16:1$^{\Delta 9}$ | 0.3 | 0.2 | 0.2 | 0.2 | 3.0 | 3.1 | 2.4 | 1.2 | 1.1 | 0.7 |
| C16:3$^{\Delta 7,12,15}$ | 3.6 | 0.6 | 3.2 | 1.2 | 0.1 | 0.1 | 0.1 | 0.3 | 0.3 | 0.2 |
| C18:0 | 2.4 | 3.3 | 2.7 | 3.9 | 3.2 | 2.8 | 2.8 | 4.6 | 4.5 | 4.1 |
| C18:1$^{\Delta 9}$ | 1.3 | 0.8 | 2.3 | 0.7 | 17.6 | 21.2 | 21.7 | 16.4 | 11.1 | 10.7 |
| C18:1$^{\Delta 11}$ | 0.1 | 0.1 | 0.1 | 0.1 | 2.1 | 1.8 | 1.5 | 0.9 | 0.8 | 0.7 |
| C18:2$^{\Delta 9,12}$ | 23.7 | 17.5 | 24.3 | 15.2 | 28.2 | 22.0 | 17.0 | 36.5 | 32.6 | 24.6 |
| C18:3$^{\Delta 9,12,15}$ | 59.3 | 60.9 | 56.4 | 62.2 | 11.3 | 12.8 | 13.2 | 9.5 | 11.9 | 14.8 |
| C20:0 | 0.3 | 0.4 | 0.3 | 0.5 | 1.4 | 1.2 | 1.3 | 2.1 | 2.1 | 2.1 |
| C20:1$^{\Delta 11}$ | 0.1 | 0.1 | 0.1 | 0.0 | 0.1 | 0.1 | 0.1 | 0.3 | 0.2 | 0.1 |
| C20:2$^{\Delta 11,14}$ | 0.2 | 0.2 | 0.2 | 0.1 | 0.1 | 0.0 | 0.0 | 0.1 | 0.1 | 0.0 |
| C20:3$^{\Delta 11,14,17}$ | 0.1 | 0.2 | 0.1 | 0.1 | 0.0 | 0.0 | 0.0 | 0.0 | 0.0 | 0.0 |
| C22:0 | 0.0 | 0.1 | 0.1 | 0.1 | 0.8 | 0.7 | 0.9 | 1.2 | 1.2 | 1.5 |
| C24:0 | 0.3 | 0.2 | 0.2 | 0.2 | 0.7 | 0.5 | 0.7 | 0.9 | 0.8 | 1.4 |

[a] Leaf samples were taken from wild type at flowering stage and from the three pJP3503 primary transformants during seed setting.
[b] leaf stages by colour indicated by 'G', green; 'YG', yellow-green; 'Y', yellow
[c] very old leaf

TABLE 35

Total lipid yield (% weight of leaf dry weight) and fatty acid composition of total lipid isolated from differently aged leaves of wild-type and three selected tobacco plants transformed with pJP3503.

| | Plant: | | | | | | | | | | |
|---|---|---|---|---|---|---|---|---|---|---|---|
| | Wild type | | | Plant 21 | | Plant 4 | | | Plant 29 | | |
| | | | | | Leaf stage[a] | | | | | | |
| | G[b] | G[c] | YG | G | YG | G | YG | Y | G | YG | Y |
| %/leaf DW | 2.4 | 1.8 | 1.4 | 2.3 | 2.1 | 11.6 | 15.8 | 13.0 | 10.1 | 8.8 | 3.7 |
| C14:0 | 0.1 | 0.2 | 0.1 | 0.2 | 0.1 | 0.2 | 0.1 | 0.1 | 0.1 | 0.1 | 0.2 |
| C16:0 | 11.6 | 11.9 | 16.0 | 11.9 | 13.7 | 26.6 | 30.0 | 34.6 | 21.0 | 28.0 | 29.4 |
| C16:1$^{\Delta 3t}$ | 4.1 | 6.3 | 3.2 | 3.1 | 2.0 | 0.5 | 0.4 | 0.5 | 0.8 | 0.6 | 0.9 |
| C16:1$^{\Delta 9}$ | 0.0 | 0.0 | 0.0 | 0.0 | 0.0 | 3.0 | 2.9 | 2.3 | 1.2 | 1.1 | 0.7 |
| C16:3$^{\Delta 7,12,15}$ | 6.7 | 5.3 | 3.6 | 5.6 | 5.3 | 0.4 | 0.3 | 0.3 | 1.0 | 0.9 | 1.5 |
| C18:0 | 2.4 | 2.9 | 4.1 | 3.0 | 3.2 | 2.9 | 2.6 | 2.8 | 3.7 | 4.0 | 3.7 |
| C18:1$^{\Delta 9}$ | 1.4 | 1.2 | 0.9 | 1.4 | 0.5 | 15.8 | 20.2 | 20.8 | 13.6 | 10.2 | 11.3 |
| C18:1$^{\Delta 11}$ | 0.5 | 0.9 | 0.4 | 0.4 | 0.2 | 2.1 | 1.9 | 1.5 | 0.9 | 0.7 | 0.7 |
| C18:2$^{\Delta 9,12}$ | 16.0 | 15.5 | 16.5 | 15.6 | 12.4 | 28.9 | 23.3 | 18.6 | 34.6 | 33.4 | 26.8 |
| C18:3$^{\Delta 9,12,15}$ | 54.4. | 51.4 | 52.3 | 57.0 | 60.9 | 16.7 | 15.8 | 15.3 | 19.1 | 17.1 | 20.3 |
| C20:0 | 0.5 | 0.6 | 0.8 | 0.4 | 0.5 | 1.2 | 1.0 | 1.3 | 1.6 | 1.7 | 1.6 |
| C20:1$^{\Delta 11}$ | 0.1 | 0.0 | 0.0 | 0.0 | 0.0 | 0.1 | 0.1 | 0.1 | 0.2 | 0.2 | 0.1 |
| C20:2$^{\Delta 11,14}$ | 0.1 | 0.1 | 0.1 | 0.1 | 0.1 | 0.0 | 0.0 | 0.0 | 0.1 | 0.1 | 0.0 |
| C20:3$^{\Delta 11,14,17}$ | 0.1 | 0.1 | 0.1 | 0.1 | 0.1 | 0.0 | 0.0 | 0.0 | 0.0 | 0.0 | 0.0 |
| C22:0 | 0.3 | 0.4 | 0.5 | 0.2 | 0.3 | 0.7 | 0.7 | 0.9 | 0.9 | 1.1 | 1.3 |
| C24:0 | 0.3 | 0.3 | 0.4 | 0.2 | 0.3 | 0.6 | 0.5 | 0.7 | 0.7 | 0.8 | 1.2 |

[a] samples taken from plants harbouring multiple seed pods unless indicated otherwise,
[b] before flowering,
[c] during flowering Analysis of Tobacco Plants Transformed with pJP3502

For the transformation with pJP3502 ("3 gene construct"), the sucrose level in the MS agar medium was reduced to half the standard level until sufficient calli were established, which aided the recovery of transformants expressing WRI1. Forty-one primary transformants were obtained from the transformation with pJP3502 and transferred to the greenhouse. Leaf samples of different age were collected at either flowering or seed setting stages (Table 36). The plants look phenotypically normal except for three transformants, originating from the same callus in the transformation procedure and therefore likely to be from the same transformation event, which were slightly smaller and displayed a glossy leaf phenotype similar to that observed for plant 4 with pJP3503 (above) but less in extent.

Leaf disk samples of primary transformants were harvested during flowering and TAG was quantified visualized by iodine staining after TLC. Selected transgenic plants displaying increased TAG levels compared to the wild type controls were further analyzed in more detail by TLC and GC. The highest TAG level in young green leaves was detected in line 8.1 and corresponded to 8.3% TAG on a dry weight basis or an approximate 83-fold increase compared to wild type leaves of the same age (Table 36). Yellow-green leaves typically contained a higher oil content compared to younger green leaves with maximum TAG levels observed in line 14.1 (17.3% TAG on a dry weight basis). Total lipid content and fatty acid composition of total lipid in the leaves was also quantitated (Table 37).

Seed (T1 seed) was collected from the primary transformants at seed maturity and some were sown to produce T1 plants. These plants were predicted to be segregating for the transgene and therefore some null segregants were expected in the T1 populations, which could serve as appropriate negative controls in addition to known wild-type plants which were grown at the same time and under the same conditions. 51 T1 plants, derived from primary transformant 14.1 which had a single-copy T-DNA insertion, which were 6-8 weeks of age and 10-25 cm in height were analysed together with 12 wild-type plants. The plants appeared phenotypically normal, green and healthy, and did not appear smaller than the corresponding wild-type plants. Leaf samples of about 1 cm diameter were taken from fully expanded green leaves. 30 of the T1 plants showed elevated TAG levels in the leaves, of which 8 plants showed high levels of TAG, about double the level of TAG compared to the primary transformant 14.1 at the same stage of plant development. These latter plants are likely to be homozygous for the transgenes. The level of TAG and the TAG fatty acid composition in leaves of selected T1 plants were measured by loading lipid isolated from about 5 mg dry weight of leaf tissue onto each TLC lane, the data is shown in Table 38.

TABLE 36

TAG levels (% weight of leaf dry weight) and fatty acid composition of TAG isolated from green leaves from ten selected tobacco plants transformed with pJP3502.

| Line | 2.1[a] | 8.1 | 8.1 | 10.1 | 10.1 | 10.2 | 10.2 | 13.4 | 14.1 | 14.1 | 14.2 | 14.2 | 14.3 | 14.3 | 19.1 | 19.1 | 19.2 | 19.2 |
|---|---|---|---|---|---|---|---|---|---|---|---|---|---|---|---|---|---|---|
| Stage[b] | Y | F | Y | F | Y | S | Y | F | S | Y | S | Y | F | Y | F | Y | F | Y |
| TAG (% dry weight) | 2.5 | 8.3 | 7.2 | 6.2 | 11.8 | 6.4 | 7.6 | 5.7 | 4.6 | 17.3 | 2.5 | 12.6 | 3 | 2 | 5.1 | 5.5 | 4.3 | 3.2 |
| C14:0 | 0.1 | 0.1 | 0.1 | 0.1 | 0.1 | 0.1 | 0.1 | 0.2 | 0.2 | 0.1 | 0.2 | 0.1 | 0.1 | 0.2 | 0.1 | 0.1 | 0.2 | 0.1 |
| C16:0 | 26.4 | 28.5 | 31.4 | 22.6 | 24.0 | 26.9 | 29.7 | 28 | 28.2 | 28.6 | 20.1 | 27.3 | 19.4 | 30.4 | 23.2 | 34.5 | 25.4 | 36.7 |
| C16:1 Δ3 | 0.4 | 0.3 | 0.4 | 0.3 | 0.3 | 0.3 | 0.4 | 0.3 | 0.3 | 0.4 | 0.5 | 0.3 | 0.2 | 0.0 | 0.3 | 0.4 | 0.3 | 0.2 |
| C16:1 Δ9 | 0.6 | 1.8 | 1.0 | 1.4 | 1.1 | 1.4 | 1.0 | 2 | 1.7 | 1.6 | 1.1 | 1.3 | 2.2 | 2.9 | 1.4 | 0.9 | 1.3 | 0.8 |
| C16:3 Δ7,12,15 | 0.3 | 0.4 | 0.4 | 0.3 | 0.4 | 0.3 | 0.4 | 0.2 | 0.3 | 0.2 | 0.5 | 0.3 | 0.3 | 0.1 | 0.2 | 0.3 | 0.4 | 0.3 |
| C18:0 | 7.1 | 3.8 | 4.0 | 3.8 | 3.5 | 4 | 4.0 | 4.2 | 4.1 | 4.1 | 4.5 | 3.9 | 3.3 | 3.0 | 4 | 4.2 | 4.3 | 4.3 |
| C18:1 Δ9 | 9.6 | 18.1 | 11.2 | 33.1 | 25.1 | 21.3 | 10.4 | 24.8 | 18.6 | 25.8 | 16.1 | 17.3 | 14 | 1.9 | 25.5 | 8.5 | 20.2 | 10.4 |
| C18:1 Δ11 | 0.5 | 1.2 | 0.8 | 1.3 | 0.8 | 1 | 0.7 | 1.2 | 1.1 | 1.0 | 0.8 | 0.8 | 1 | 0.7 | 1.3 | 0.6 | 1.4 | 0.7 |
| C18:2 Δ9,12 | 31.3 | 30.5 | 32.0 | 28 | 31.3 | 32.3 | 37.3 | 25.8 | 30.7 | 24.3 | 37.3 | 33.8 | 35.5 | 15.3 | 33.5 | 30.1 | 33.5 | 20.8 |
| C18:3 Δ9,12,15 | 17.9 | 10.8 | 13.2 | 5.9 | 10.2 | 8.1 | 10.2 | 8.8 | 9.4 | 9.8 | 14.6 | 10.2 | 21.5 | 44.0 | 6.5 | 15.7 | 8.5 | 21.1 |
| C20:0 | 3 | 2 | 2.3 | 1.5 | 1.6 | 2 | 2.5 | 2 | 2.4 | 2.0 | 2.1 | 2.2 | 1.2 | 0.9 | 1.7 | 2.2 | 2 | 2.0 |
| C20:1 Δ11 | 0.3 | 0.3 | 0.3 | 0.3 | 0.0 | 0.3 | 0.3 | 0.3 | 0.4 | 0.0 | 0.5 | 0.0 | 0.3 | 0.0 | 0.4 | 0.0 | 0.4 | 0.2 |
| C20:2 Δ11,14 | 0.1 | 0.1 | 0.1 | 0 | 0.1 | 0.1 | 0.1 | 0 | 0.1 | 0.1 | 0 | 0.1 | 0.1 | 0.0 | 0.1 | 0.0 | 0.1 | 0.0 |
| C20:3 Δ11,14,17 | 0 | 0 | 0.0 | 0 | 0.0 | 0 | 0.0 | 0 | 0 | 0.0 | 0 | 0.0 | 0 | 0.0 | 0 | 0.0 | 0 | 0.0 |
| C22:0 | 1.6 | 1.2 | 1.7 | 0.8 | 1.0 | 1.2 | 1.8 | 1.1 | 1.5 | 1.1 | 1 | 1.4 | 0.5 | 0.3 | 0.9 | 1.4 | 1.1 | 1.2 |
| C24:0 | 0.9 | 0.9 | 1.1 | 0.6 | 0.7 | 0.8 | 1.2 | 0.9 | 1.1 | 1.0 | 0.8 | 1.1 | 0.4 | 0.3 | 0.7 | 1.1 | 0.9 | 1.1 |

[a] very old plant containing only yellow leaves
[b] seed setting ('S'), flowering ('F'), yellow or yellowing leaves ('Y')

TABLE 37

Total lipid and fatty acid composition of total lipid extracted from yellow leaves from selected tobacco plants transformed with pJP3502 (DGAT1 + WRI1 + Oleosin)

| Line | C14:0 | C16:0 | C16d3 | 16:1w13t | C16:1 | C16:3 | C18:0 | C18:1 | C18:1d11 | C18:2 |
|---|---|---|---|---|---|---|---|---|---|---|
| 14.1 | 0.1 | 26.6 | 0.0 | 0.6 | 1.6 | 0.3 | 3.8 | 25.6 | 1.1 | 25.2 |
| 14.2 | 0.1 | 25.2 | 0.0 | 0.6 | 1.3 | 0.4 | 3.6 | 16.5 | 0.8 | 35.1 |
| 10.1 | 0.1 | 22.4 | 0.0 | 0.7 | 1.3 | 0.6 | 3.2 | 24.3 | 0.8 | 31.9 |
| 13.4 | 0.2 | 19.6 | 0.0 | 3.6 | 0.0 | 1.7 | 4.1 | 3.9 | 0.6 | 34.6 |

| Line | C18:3n3 DW | C20:0 | C20:1d11 | C20:2n6 | C20:3n3 | C22:0 | C24:0 | mg/100 mg |
|---|---|---|---|---|---|---|---|---|
| 14.1 | 11.0 | 1.8 | 0.3 | 0.1 | 0.0 | 1.0 | 0.9 | 23.4 |
| 14.2 | 11.6 | 1.9 | 0.3 | 0.1 | 0.0 | 1.5 | 1.0 | 15.5 |
| 10.1 | 11.4 | 1.5 | 0.3 | 0.0 | 0.0 | 0.9 | 0.6 | 9.7 |
| 13.4 | 27.7 | 1.6 | 0.3 | 0.0 | 0.0 | 1.5 | 0.8 | 2.0 |

TABLE 38

TAG levels (% weight of leaf dry weight) and fatty acid composition of TAG isolated from green leaves from selected tobacco T1 plants transformed with pJP3502.

| Line No. | 16:0 | 16:1 | 18:0 | 18:1d9 | 18:1d11 | 18:2 | 18:3n3 | 20:0 | 22:0 | 24:0 | % TAG |
|---|---|---|---|---|---|---|---|---|---|---|---|
| 4.1  | 23.3 | 0.9 | 3.3 | 11.3 | 1.5 | 44.8 | 10.7 | 1.9 | 1.4 | 0.9 | 3.7 |
| 4.2  | 22.4 | 0.9 | 3.1 | 13.3 | 1.5 | 44.3 | 10.5 | 1.8 | 1.3 | 0.9 | 6.1 |
| 4.3  | 24.2 | 1.0 | 3.4 | 14.9 | 1.6 | 41.8 | 9.0  | 1.9 | 1.3 | 0.9 | 4.0 |
| 6.1  | 24.6 | 0.9 | 3.9 | 16.5 | 1.4 | 33.4 | 14.4 | 2.1 | 1.5 | 1.3 | 3.5 |
| 6.2  | 22.8 | 0.8 | 3.8 | 18.6 | 1.4 | 32.7 | 15.1 | 2.1 | 1.5 | 1.1 | 3.4 |
| 6.3  | 26.6 | 1.0 | 4.2 | 16.2 | 1.5 | 31.0 | 15.6 | 2.3 | 1.6 | 0.0 | 2.3 |
| 8.1  | 27.0 | 1.0 | 4.8 | 18.3 | 1.5 | 27.1 | 15.9 | 2.6 | 1.9 | 0.0 | 1.5 |
| 8.2  | 24.2 | 1.0 | 4.3 | 19.0 | 1.4 | 27.6 | 16.7 | 2.5 | 1.8 | 1.5 | 2.2 |
| 8.3  | 26.5 | 1.3 | 4.8 | 22.0 | 1.7 | 24.9 | 16.2 | 2.6 | 0.0 | 0.0 | 1.2 |
| 13.1 | 33.7 | 1.3 | 5.0 | 7.4  | 1.3 | 34.2 | 14.2 | 2.8 | 0.0 | 0.0 | 1.2 |
| 13.2 | 29.1 | 1.1 | 4.4 | 7.2  | 1.3 | 37.2 | 17.1 | 2.6 | 0.0 | 0.0 | 1.6 |
| 13.3 | 34.3 | 0.0 | 5.5 | 6.9  | 0.0 | 36.4 | 13.7 | 3.2 | 0.0 | 0.0 | 0.8 |
| 21.1 | 27.4 | 0.7 | 4.2 | 8.5  | 1.2 | 37.1 | 15.4 | 2.4 | 1.6 | 1.4 | 2.1 |
| 21.2 | 29.7 | 0.9 | 4.5 | 9.1  | 1.3 | 36.3 | 15.9 | 2.3 | 0.0 | 0.0 | 1.6 |
| 21.3 | 27.1 | 0.8 | 4.3 | 12.7 | 1.4 | 37.1 | 13.0 | 2.2 | 1.4 | 0.0 | 2.4 |
| 29.1 | 27.2 | 0.8 | 4.3 | 12.8 | 1.1 | 34.9 | 14.4 | 2.1 | 1.4 | 1.0 | 3.9 |
| 29.2 | 26.9 | 1.0 | 4.1 | 14.7 | 1.2 | 35.3 | 13.0 | 2.0 | 1.2 | 0.8 | 3.8 |
| 29.3 | 25.7 | 1.4 | 4.1 | 18.4 | 1.2 | 35.7 | 11.0 | 1.6 | 1.0 | 0.0 | 3.7 |
| 23.1 | 29.9 | 0.9 | 4.3 | 8.1  | 1.2 | 35.0 | 18.4 | 2.1 | 0.0 | 0.0 | 1.6 |
| 23.2 | 30.8 | 1.0 | 4.8 | 9.3  | 1.3 | 33.5 | 17.2 | 2.3 | 0.0 | 0.0 | 1.5 |
| 23.3 | 29.2 | 0.9 | 4.3 | 9.1  | 1.3 | 36.2 | 15.2 | 2.3 | 1.5 | 0.0 | 2.3 |
| 49.1 | 27.0 | 0.9 | 3.9 | 5.8  | 1.4 | 43.8 | 11.0 | 2.5 | 2.1 | 1.5 | 2.4 |
| 49.2 | 27.5 | 0.9 | 3.8 | 7.1  | 1.5 | 44.7 | 10.2 | 2.4 | 2.0 | 0.0 | 2.2 |

Genetic constructs suitable for transformation of monocotyledonous plants are made by exchanging the Arath-SSU promoters in pJP3502 and pJP3503 for promoters more active in monocots. Suitable promoters include constitutive viral promoters from monocot viruses or promoters that have demonstrated to function in a transgenic context in monocot species (e.g., the maize Ubi promoter described by Christensen et al., 1996). Similarly, the CaMV-35S promoters in pJP3502 and pJP3503 are exchanged for promoters that are more active in monocot species. These constructs are transformed into wheat, barley and maize using standard methods.

Miscanthus Species

Genetic constructs for Miscanthus species transformation are made by exchanging the Arath-SSU promoters in pJP3502 and pJP3503 for promoters more active in Miscanthus. Suitable promoters include constitutive viral promoters, a ubiquitin promoter (Christensen et al., 1996) or promoters that have demonstrated to function in a transgenic context in Miscanthus. Similarly, the CaMV-35S promoters in pJP3502 and pJP3503 are exchanged for promoters that are more active in Miscanthus. New constructs are transformed in Miscanthus by a microprojectile-mediated method similar to that described by Wang et al., 2011.

Switchgrass (Panicum virgatum)

Genetic constructs for switchgrass transformation are made by exchanging the Arath-SSU promoters in pJP3502 and pJP3503 for promoters more active in switchgrass. Suitable promoters include constitutive viral promoters or promoters that have demonstrated to function in a transgenic context in switchgrass (e.g., Mann et al., 2011). Similarly, the CaMV-35S promoters in pJP3502 and pJP3503 are exchanged for promoters that are more active in switchgrass. New constructs are transformed in switchgrass by an Agrobacterium-mediated method similar to that described by Chen et al., 2010 and Ramamoorthy and Kumar, 2012.

Sugarcane

Genetic constructs for sugarcane transformation are made by exchanging the Arath-SSU promoters in pJP3502 and pJP3503 for promoters more active in sugarcane. Suitable promoters include constitutive viral promoters or promoters that have demonstrated to function in a transgenic context in sugarcane (e.g., the maize Ubi promoter described by Christensen et al., 1996). Similarly, the CaMV-35S promoters in pJP3502 and pJP3503 are exchanged for promoters that are more active in sugarcane. New constructs are transformed in sugarcane by a microprojectile-mediated method similar to that described by Bower et al., 1996.

Elephant Grass

Genetic constructs for Pennisetum purpureum transformation are made by exchanging the Arath-SSU promoters in pJP3502 and pJP3503 for promoters more active in elephant grass. Suitable promoters include constitutive viral promoters or promoters that have demonstrated to function in a transgenic context in Pennisetum species such as P. glaucum like (e.g. the maize Ubi promoter described by Christensen et al., 1996). Similarly, the CaMV-35S promoters in pJP3502 and pJP3503 are exchanged for promoters that are more active in Pennisetum species. New constructs are transformed in P. purpureum by a microprojectile-mediated method similar to that described by Girgi et al., 2002.

Lolium

Genetic constructs for Lolium perenne and other Lolium species transformation are made by exchanging the Arath-SSU promoters in pJP3502 and pJP3503 for promoters more active in ryegrass. Suitable promoters include constitutive viral promoters or promoters that have demonstrated to function in a transgenic context in Lolium species (e.g. the maize Ubi promoter described by Christensen et al., 1996). Similarly, the CaMV-35S promoters in pJP3502 and pJP3503 are exchanged for promoters that are more active in Pennisetum species. New constructs are transformed in Lolium perenne by a silicon carbide-mediated method similar to that described by Dalton et al., 2002 or an Agrobacterium-mediated method similar to that described by Bettany et al., 2003.

pJP3502 and pJP3503 are modified to seed-specific expression genetic constructs by exchanging the CaMV-35S and Arath-SSU promoters (except the selectable marker cassette) with seed-specific promoters active in the target species.

Canola

Genetic constructs for *Brassica napus* transformation are made by exchanging the CaMV-35S and Arath-SSU promoters in pJP3502 and pJP3503 for promoters more active in canola. Suitable promoters include promoters that have previously been demonstrated to function in a transgenic context in *Brassica napus* (e.g., the *A. thaliana* FAE1 promoter, *Brassica napus* napin promoter, *Linum* usitatissimum conlinin1 and conlinin2 promoters). New constructs are transformed in *B. napus* as previously described.

Soybean (*Glycine max*)

A genetic construct is made by cloning the PspOMI fragment from a synthesised DNA fragment having the nucleotide sequence shown in SEQ ID NO:415 (Soybean synergy insert; FIG. 19A) into a binary vector such as pORE04 at the NotI site. This fragment contains Arath-WRI1 expressed by a Arath-FAE1 promoter, Arath-DGAT1 expressed by a Linus-Cnl2 promoter, Musmu-MGAT2 expressed by Linus-Cnl1 and Arath-GPAT4 expressed by Linus-Cnl1. A further genetic construct is made by exchanging the GPAT coding region for an oleosin coding region. A further genetic construct is made by deleting the MGAT expression cassette.

A genetic construct, pJP3569 (FIG. 21), was generated by cloning the SbfI-PstI fragment from the DNA molecule having the nucleotide sequence shown in SEQ ID NO:415 into the PstI site of pORE04. This construct contained (i) a coding region encoding the *A. thaliana* WRI1 transcription factor, codon optimised for *G. max* expression, and expressed from the *G. max* kunitz trypsin inhibitor 3 (Glyma-KTi3) promoter, (ii) a coding region encoding the *Umbelopsis ramanniana* DGAT2A (codon optimised as described by Lardizabal et al., 2008) and expressed from the *G. max* alpha-subunit beta-conglycinin (Glyma-b-conglycinin) promoter and (iii) a coding region encoding the *M. musculus* MGAT2, codon optimised for *G. max* expression. A second genetic construct, pJP3570, was generated by cloning the SbfI-SwaI fragment of the DNA molecule having the nucleotide sequence shown in SEQ ID NO:415 into pORE04 at the EcoRV-PstI sites to yield a binary vector containing genes expressing the *A. thaliana* WRI1 transcription factor and *U. ramanniana* DGAT2A enzyme. Similarly, a third genetic construct, pJP3571, was generated by cloning the AsiSI fragment of the DNA molecule having the nucleotide sequence shown in SEQ ID NO:415 into the AsiSI site of pORE04 to yield a binary vector containing a gene encoding the *U. ramanniana* DGAT2A enzyme. A fourth genetic construct, pJP3572, was generated by cloning the NotI fragment of the DNA molecule having the nucleotide sequence shown in SEQ ID NO:415 into pORE04 at the NotI site to yield a binary vector containing a gene expressing the *A. thaliana* WRI1 transcription factor. A fifth genetic construct, pJP3573, was generated by cloning the SwaI fragment of the DNA molecule having the nucleotide sequence shown in SEQ ID NO:415 into pORE04 at the EcoRV site to yield a binary vector containing the gene encoding *M. musculus* MGAT2.

A sixth genetic construct, pJP3580, is generated by replacing the *M. musculus* MGAT2 with the *Sesamum indicum* oleosin gene.

Each of these six constructs are used to transform soybean, using the methods as described in Example 6. Transgenic plants produced by the transformation with each of the constructs, particularly pJP3569, produce seeds with increased oil content.

Sugarbeet

The vectors pJP3502 and pJP3503 (see above) as used for the transformation of tobacco are used to transform plants of sugarbeet (*Beta vulgaris*) by *Agrobacterium*-mediated transformation as described by Lindsey & Gallois (1990). The plants produce greatly increased levels of TAG in their leaves, similar in extent to the tobacco plants produced as described above. Transgenic sugarbeet plants are harvested while the leaves are still green or preferably green/yellow just prior to beginning of senescence or early in that developmental process, i.e., and while the sugar content of the beets is at a high level and after allowing accumulation of TAG in the leaves. This allows the production of dual-purpose sugarbeets which are suitable for production of both sugar from the beets and lipid from the leaves; the lipid may be converted directly to biodiesel fuel by crushing the leaves and centrifugation of the resultant material to separate the oil fraction, or the direct production of hydrocarbons by pyrolysis of the leaf material.

Promoters that are active in the root (tuber) of sugarbeet are also used to express transgenes in the tuber.

Example 21

Stable Transformation of *Solanum tuberosum* with Oil Increase Genes pJP3502, the intermediate binary expression vector described in the previous example, was modified by first excising one SSU promoter by AscI+NcoI digestion and replacing it with the potato B33 promoter flanked by AscI and NcoI to generate pJP3504. The SSU promoter in pJP3504 along with a fragment of the *A. thaliana* WRL1 gene was replaced at the PspOMI sites by a potato B33 promoter with the same *A. thaliana* WRL1 gene fragment flanked by NotI-PspOMI to generate pJP3506. The pJP3347 was added to pJP3506 as described in the above example to generate pJP3507. This construct is shown schematically in FIG. 20. Its sequence is given in SEQ ID NO:413. The construct is used to transform potato (*Solanum tuberosum*) to increase oil content in tubers.

Example 22

GPAT-MGAT Fusion Enzymes

The enzyme activity of GPAT-MGAT enzyme fusions is tested to determine whether this would increase the accessibility of the GPAT-produced MAG for MGAT activity. A suitable linker region was first synthesised and cloned into a cloning vector. This linker contained suitable sites for cloning the N-terminal (EcoRI-ZraI) and C-terminal coding regions (NdeI-SmaI or NdeI-PstI).

```
                                        (SEQ ID NO: 414)
atttaaatgcggccgcgaattcgtcgattgaggacgtccctactagacc tgctggacctcctcctgctacttactacgattactcgctgtgcatatgg tcagtcatgcccgggcctgcaggcggccgcatttaaat
```

A GPAT4-MGAT2 fusion (GPAT4 N-terminus and MGAT2 C-terminus) was made by first cloning a DNA fragment encoding the *A. thaliana* GPAT4, flanked by MfeI and ZraI sites and without a C-terminal stop codon, into the EcoRI-ZraI sites. The DNA fragment encoding the *M. musculus* MGAT2, flanked by NdeI-PstI sites, was then cloned into the NdeI-PstI sites to generate a single GPAT4-MGAT2 coding sequence. The fused coding sequence was then cloned as a NotI fragment into pYES2 to generate pYES2::GPAT4-MGAT2 and the constitutive binary expression vector pJP3343 to generate pJP3343::GPAT4-MGAT2.

Similarly, a MGAT2-GPAT4 fusion (MGAT2 N-terminus and GPAT4 C-terminus) was made by first cloning the DNA fragment encoding *M. musculus* MGAT2, flanked by EcoRI and ZraI sites without a C-terminal stop codon, into the EcoRI-ZraI sites. The DNA fragment encoding the *A. thaliana* GPAT4, flanked by NdeI-PstI sites, was then cloned into the NdeI-PstI sites to generate a single MGAT2-GPAT4 coding sequence. The fused coding sequence was then cloned as a NotI fragment into pYES2 to generate pYES2::MGAT2-GPAT4 and the constitutive binary expression vector pJP3343 to generate pJP3343::MGAT2-GPAT4.

The yeast expression vectors are tested in yeast *S. cerevisiae* and the binary vectors are tested in *N. benthamiana* and compared for oil content and composition with single-coding region controls.

Example 23

Discovery of Novel WRL1 Sequences

Three novel WRL1 sequences are cloned into pJP3343 and other suitable binary constitutive expression vectors and tested in *N. benthamiana*. These include the genes encoding Sorbi-WRL1 (from *Sorghum bicolor*; SEQ ID NO:334), Lupan-WRL1 (from *Lupinus angustifolius*; SEQ ID NO:335) and Ricco-WRL1 (from *Ricinus communis*; SEQ ID NO:336). These constructs are tested in comparison with the *Arabidopsis* WRI1-encoding gene in the *N. benthamiana* leaf assay.

As an initial step in the procedure, a partial cDNA fragment corresponding to the WRL1 was identified in the developing seed EST database of *Lupinus angustifolius* (NA-080818_Plate14f06.b1, SEQ ID NO:277). A full-length cDNA (SEQ ID NO:278) was subsequently recovered by performing 5'- and 3'-RACE PCR using nested primers and cDNAs isolated from developing seeds of *Lupinus angustifolius*. The full length cDNA was 1729 bp long, including a 1284 bp protein coding sequence encoding a predicted polypeptide of 428 amino acids (SEQ ID NO:337). The entire coding region of the full length lupin WRL1 cDNA was then PCR amplified using forward and reverse primers which both incorporated EcoRI restriction sites to facilitate the cloning into the pJP3343 vector under the control of a 35S promoter in the sense orientation. *A. tumefaciens* strain AGL1 harbouring the pJP3343-LuangWRL1 was infiltrated in *N. benthamiana* leave tissues as described in Example 1. Leaf discs transiently expressing the pJP3343-LuangWRL1 were then harvested and analysed for oil content.

Example 24

Silencing of the CGI-58 Homologue in *N. Tabacum*

James et al. (2010) have reported that the silencing of the *A. thaliana* CGI-58 homologue resulted in up to 10-fold TAG accumulation in leaves, mainly as lipid droplets in the cytosol. Galactolipid levels were also found to be higher, whereas levels of most major phospholipid species remained unchanged. Interestingly, TAG levels in seeds were unaffected and, unlike other TAG degradation mutants, no negative effect on seed germination was observed.

Three full length and two partial transcripts were found in the *N. benthamiana* transcriptome showing homology to the *A. thaliana* CGI-58 gene. A 434 bp region present in all five transcripts was amplified from *N. benthamiana* isolated leaf RNA and cloned via LR cloning (Gateway) into the pHELLS-GATE12 destination vector. The resulting expression vector designated pTV46 encodes a hairpin RNA (dsRNA) molecule for reducing expression of the tobacco gene encoding the homologue of CG1-58 and was used to transform *N. tabacum* as described in Example 1, yielding 52 primary transformants.

Primary transformants displaying increased TAG levels in their vegetative tissues are crossed with homozygous lines described in Example 20.

Example 25

Silencing of the *N. tabacum* ADP-Glucose Pyrophosphorylase (AGPase) Small Subunit Sanjaya et al. (2011) demonstrated that silencing of the AGPase small subunit in combination with WRI over-expression further increases TAG accumulation in *A. thaliana* seedlings while starch levels were reduced. An AGPase small subunit has been cloned from flower buds (Kwak et al., 2007). The deduced amino acid sequence showed 87% identity with the *A. thaliana* AGPase. A 593 bp fragment was synthesized and cloned into pHELLSGATE12 via LR cloning (Gateway) resulting in the binary vector pTV35. Transformation of *N. tabacum* was done as described in Example 1 and yielded 43 primary transformants.

Primary transformants displaying a reduction in total leaf starch levels are crossed with homozygous lines described in Examples 20 and 21. In addition, primary transformants are crossed with homozygous lines that are the result of a crossing of the lines described in 20 and 21.

Example 26

Production and Use of Constructs for Gene Combinations Including an Inducible Promoter Further genetic constructs are made using an inducible promoter system to drive expression of at least one of the genes in the combinations of genes as described above, particularly in pJP3503 and pJP3502. In the modified constructs, the WRI1 gene is expressed by an inducible promoter such as the *Aspergilus niger* alcA promoter in the presence of an expressed *Aspergilus niger* alcR gene. Alternatively, a DGAT is expressed using an inducible promoter. This is advantageous when maximal TAG accumulation is not desirable at all times during development. An inducible promoter system or a developmentally-controlled promoter system, preferably to drive the transcription factor such as WRI1, allows the induction of the high TAG phenotype at an appropriate time during development, and the subsequent accumulation of TAG to high levels.

TAG can be further increased by the co-expression of transcription factors including embryogenic transcription factors such as LEC2 or BABY BOOM (BBM, Srinivasan et al., 2007). These are expressed under control of inducible promoters are described above and super-transformed on transgenic lines or co-transformed with WRI and DGAT.

pJP3590 is generated by cloning a MAR spacer as a AatII fragment into the AatII site of pORE04. pJP3591 is generated by cloning a second MAR spacer as an KpnI fragment into the KpnI site of pJP3590. pJP3592 is generated by cloning the AsiSI-SmaI fragment of the DNA molecule having the nucleotide sequence shown in SEQ ID NO:416 (12ABFJYC_pJP3569_insert; FIG. 19B) into the AsiSI-EcoRV sites of pJP3591. pJP3596 is generated by cloning a PstI-flanked inducible expression cassette containing the alcA promoter expressing the *M. musculus* MGAT2 and a

*Glycine max* lectin polyadenylation signal into an introduced SbfI site in pJP3592. Hygromycin-resistant versions of both pJP3592 and pJP3596 (pJP3598 and pJP3597, respectively) are generated by replacing the NPTII selectable marker gene with the HPH flanked gene at the FseI-AscI sites.

These constructs are used to transform the same plant species as described in Example 20. Expression from the inducible promoter is increased by treatment with the inducer of the transgenic plants after they have grown substantially, so that they accumulate increased levels of TAG. These constructs are also super-transformed in stably transformed constructs already containing an oil-increase construct including the three-gene or four-gene TDNA region (SEQ ID NO:411 and SEQ ID NO: 412, respectively). Alternatively, the gene expression cassettes from the three-gene and four-gene constructs are cloned into the NotI sites of pJP3597 and pJP3598 to yield a combined constitutive and inducible vector system for high fatty acid and TAG synthesis, accumulation and storage.

In addition to other inducible promoters, an alternative is that gene expression can be temporally and spatially restricted by using promoters that are only active during specific developmental periods or in specific tissues. Endogenous chemically inducible promoters are also used to limit expression to specific developmental windows.

It will be appreciated by persons skilled in the art that numerous variations and/or modifications may be made to the invention as shown in the specific embodiments without departing from the spirit or scope of the invention as broadly described. The present embodiments are, therefore, to be considered in all respects as illustrative and not restrictive.

The present application claims priority from U.S. 61/580,590 filed 27 Dec. 2011 and U.S. 61/718,563 filed 25 Oct. 2012, the entire contents of both of which are incorporated herein by reference.

All publications discussed and/or referenced herein are incorporated herein in their entirety.

Any discussion of documents, acts, materials, devices, articles or the like which has been included in the present specification is solely for the purpose of providing a context for the present invention. It is not to be taken as an admission that any or all of these matters form part of the prior art base or were common general knowledge in the field relevant to the present invention as it existed before the priority date of each claim of this application.

REFERENCES

Abdullah et al. (1986) Biotech. 4:1087.
Al-Mariri et al. (2002) Infect. Immun 70:1915-1923.
Alemanno et al. (2008) Planta 227:853-866.
Almeida and Allshire (2005) TRENDS Cell Biol. 15:251-258.
Alonso et al. (2010) Green Chem. 12:1493-1513.
Alvarez et al. (2000) Theor. Appl. Genet. 100:319-327.
Andrianov et al. (2010) Plant Biotech. J. 8:277-287.
Barthole et al. (2011) Plant Sci. 185-186:33-39.
Bartlett et al. (2008) Plant Methods 4:22.
Baud et al. (2007) Plant J. 50:825-838.
Baumlein et al. (1991) Mol. Gen. Genet. 225:459-467.
Baumlein et al. (1992) Plant J. 2:233-239.
Benghezal et al. (2007) J. Biol. Chem. 282:30845-30855.
Bettany et al. (2003) Plant Cell Rep. 21:437-444.
Bligh and Dyer (1959) Canadian Journal of Biochemistry and Physiology 37:911-917.
Bohner et al. (1999) Plant J. 19:87-95.
Bourque (1995) Plant Sci. 105:125-149.
Boutilier et al. (2002) Plant Cell 14:1737-1749.
Bouvier-Nave et al. (2000) European Journal of Biochemistry/FEBS 267:85-96.
Bower et al. (1996) Mol. Breed. 2: 239-249.
Bradford (1976) Anal. Biochem. 72:248-254.
Broothaerts et al. (2005) Nature 433:629-633.
Broun et al. (1998) Plant J. 13:201-210.
Bruce et al. (2000) P. Plant Cell 12:65-80.
Buchanan-Wollaston (1994) Plant Physiol. 105:839-846.
Busk et al. (1997) Plant J. 11:1285-1295.
Cadwell and Joyce (1992) PCR Methods Appl. 2:28-33.
Cao et al. (2003) J. Biol. Chem. 278:13860-13866.
Cao et al. (2007) J. Lipid Res. 48:583-591.
Capuano et al. (2007) Biotechnol. Adv. 25:203-206.
Cernac and Benning (2004) Plant J. 40:575-585
Chen et al. (2010) Biotechnol. for Biofuels. 3:9.
Cheng et al. (1996) Plant Cell Rep. 15:653-657.
Cheng et al. (2003) J. Biol. Chem. 278, 13611-13614.
Chikwamba et al. (2003) Proc. Natl. Acad. Sci. U.S.A. 100: 11127-11132.
Christensen and Quail (1996) Transgenic Res. 5:213-218.
Christie (1993) Advances in Lipid Methodology—Two, Oily Press, Dundee, pages 195-213.
Chung et al. (2006) BMC Genomics 7:120.
Clough and Bent (1998) Plant J. 16:735-743.
Coco et al. (2001) Nature Biotechnology 19:354-359.
Coco et al. (2002) Nature Biotechnology 20:1246-1250.
Comai et al. (2004) Plant J 37: 778-786.
Corrado and Karali (2009) Biotechnol. Adv. 27:733-743.
Courvalin et al. (1995) Life Sci. 318:1207-1212.
Coutu et al. (2007) Transgenic Res. 16:771-781.
Crameri et al. (1998) Nature 391:288-291.
Dalton et al. (1998) Plant Science 132:31-43.
Dandik and Aksoy (1998) Fuel Process Technol. 57: 81-92.
Darji et al. (1997) Cell 91:765-775.
Dauk et al (2007) Plant Sci. 173:43-49.
Deshpande (1992) Appl. Biochem. Biotechnol. 36:227-234.
Dhadialla et al. (1998) Annu. Rev. Entomol. 43:545-569.
Dietrich et al. (1998) Nature Biotech. 18:181-185.
Dulermo and Nicaud (2011) Metab. Eng. 13:482-491.
Durrett et al. (2008) Plant J. 54:593-607.
Dyer et al. (2002) Plant Physiol. 130:2027-2038.
Eggert et al. (2005) Chembiochem 6:1062-1067.
Ellerstrom et al. (1996) Plant Mol. Biol. 32:1019-1027.
Endalew et al. (2011) Biomass and Bioenergy 35:3787-3809.
Felenbok (1991) J. Biotechnol. 17:11-17.
Fennelly et al. (1999) J. Immunol. 162:1603-1610.
Froissard et al. (2009) FEMS Yeast Res 9:428-438.
Fujimura et al. (1985) Plant Tissue Culture Lett. 2:74.
Gan (1995) Molecular characterization and genetic manipulation of plant senescence. PhD thesis. University of Wisconsin, Madison.
Gan and Amasino (1995) Science 270:1986-1988
Gatz (1997) Annu. Rev. Plant Physiol. Plant Mol. Biol. 48:89-108.
Ghosal et al. (2007) Biochimica et Biophysica Acta 1771: 1457-1463.
Ghosh et al. (2009) Plant Physiol. 151:869-881.
Girgi et al. (2002) Molecular Breeding 10:243-252.
Glevin et al. (2003) Microbiol. Mol. Biol. Rev. 67:16-37.
Goffman et al. (2005) Plant Physiol. 138:2269-2279.
Gong and Jiang (2011) Biotechnol. Lett. 33:1269-1284.
Gould et al. (1991) Plant Physiol. 95:426-434.
Grant et al. (1995) Plant Cell Rep. 15:254-258.
Greenwell et al. (2010) J. R. Soc. Interface 7:703-726.
Grillot-Courvalin et al. (1999) Curr. Opin. Biotech. 10(5): 477-481.

Grillot-Courvalin et al. (1998) Nature Biotech. 16:862-866.
Gurel et al. (2009) Plant Cell Rep. 28:429-444.
Harayama (1998) Trends Biotechnol. 16: 76-82.
Haseloff and Gerlach (1988) Nature 334:585-591.
Helling a (1997) Proc. Natl. Acad. Sci. 94:10015-10017.
Henikoff et al. (2004) Plant Physiol 135: 630-636.
Hense et al. (2001) Cell Microbiol. 3:599-609.
Hershey and Stoner (1991) Plant Mol. Biol. 17:679-690.
Hinchee et al. (1988) Biotechnology 6:915-922.
Hirayama and Hujii (1965) Agricultural and Biological Chemistry 29:1-6.
Horvath et al. (2000) Proc. Natl. Acad. Sci. U.S.A. 97:1914-1919.
Huang (1996) Plant Physiol. 110:1055-1061.
Iwabuchi et al. (2003) J. Biol. Chem. 278:4603-4610.
Izawati et al. (2009) J. Oil Palm Res. 21:643-652.
James et al. (2010) Proc. Natl. Acad. Sci. USA 107:17833-17838.
Jepson et al. (1994) Plant Mol. Biol. 26:1855-1866.
Jézéquel et al. (2008) Biotechniques 45:523-532.
Joviet et al. (2004) Plant Physiol. Biochem. 42:501-509.
Karmakar et al. (2010) Bioresource Technology 101:7201-7210.
Kindle (1990) Proc. Nat. Acad. Sci. USA 87: 1228-1232.
Klein et al. (1998) Exp. Neurol. 150:183-194.
Knothe (2005) Fuel Process. Technol. 86:1059-1070.
Knothe and Steidley (2005) Fuel 84:1059-1065.
Koziel et al. (1996) Plant Mol. Biol. 32:393-405.
Kuhn et al. (2009) J. Biol. Chem. 284:34092-102.
Kunik et al. (2001) Proc. Natl. Acad. Sci. U.S.A. 98:1871-1876.
Kwak et al. (2007) Plant Physiol. 145:277-289.
Lacroix et al. (2008) Proc. Natl. Acad. Sci. U.S.A. 105: 15429-15434.
Lakshminarayana et al. (1984) JAOCS 61:1249-1253.
Lam et al. (2010) Biotechnol. Adv. 28:500-18.
Lardizabal et al. (2001) J. Biol. Chem. 276:38862-38869.
Lardizabal et al. (2008) Plant Physiol. 148: 89-96.
Larkin et al. (1996) Transgenic Res. 5:325-335.
Lee et al. (1998) Science 280:915-918.
Leung et al. (1989) Technique 1:11-15.
Li et al. (1996) FEBS Lett. 379:117-121.
Li et al. (2006) Phytochemistry 67: 904-915.
Li et al. (2007) Proc. Natl. Acad. Sci. USA. 104:18339-44.
Lin et al. (2005) Plant Physiol. Biochem. 43:770-776.
Lindsey and Gallois (1990) Journal of Experimental Botany 41:529-536.
Liu et al. (2010a) Fuel 89:2735-2740.
Liu et al. (2010b) Plant Physiol. Biochem. 48: 9-15.
Lui et al. (2009) J. Agric. Food Chem. 57: 2308-2313.
Maher and Bressler (2007) Bioresource Technology 98:2351-2368.
Mann et al. (2011) BMC Biotechnol. 11:74.
Martinez and Jepson, Ecdysteroid agonist-inducible control of gene expression in plants. In Inducible Gene Expression in Plants. Edited by Reynolds PHS. New York: CABI Publishing; 1999:23-41.
Martinez et al. (1999) Plant J. 19:97-106.
Matsuoka et al. (1994) Plant J. 6:311-319.
Meier et al. (1997) FEBS Lett. 415:91-95.
Mett et al. (1993) Proc. Natl. Acad. Sci. USA 90:4567-4571.
Millar and Waterhouse (2005). Funct Integr Genomics 5:129-135.
Murashige and Skoog (1962) Physiologia Plantarum 15:473-497.
Needleman and Wunsch (1970) J. Mol. Biol. 45: 443-453
Ness et al. (2002) Nature Biotechnology 20:1251-1255.
Niedz et al. (1995) Plant Cell Reports 14:403-406.
Ostermeier et al. (1999) Nature Biotechnology 17:1205-1209.
Ow et al. (1986) Science 234:856-859.
Padidam (2003) Curr. Opin. Plant Biol. 6:169-77.
Padidam et al. (2003) Transgenic Res. 12:101-9.
Panekina (1978) Chemistry of Natural Compounds 14:33-36.
Parthibane et al. (2012) J. Biol. Chem. 287:1946-54.
Pasquinelli et al. (2005). Curr Opin Genet Develop 15:200-205.
Perez-Vich et al. (1998) JAOCS 75:547-555
Perriman et al. (1992) Gene 113:157-163.
Perrin et al. (2000) Mol Breed 6:345-352.
Perry and Harwood (1993) Phytochemistry 33:329-333.
Phillips et al. (2002) Journal of Food Composition and Analysis 12:123-142.
Picard (1994) Cur. Top. Biotech. 5:511-515.
Pigeaire et al. (1997) Mol. Breed. 3:341-349.
Potenza et al. (2004) In Vitro Cell Dev. Biol. Plant 40:1-22.
Powell et al. (1996) Vaccines 183, Abstract.
Prasher et al. (1985) Biochem. Biophys. Res. Commun 127: 31-36.
Qiu et al. (2001) J. Biol. Chem. 276:31561-3156
Ramamoorthy and Kumar (2012) Plant Cell Rep. 31:1923-1931.
Riddiford et al. (2000) Vitam. Horm. 60:1-73.
Rossell and Pritchard (1991) *Analysis of Oilseeds, Fats and Fatty Foods. Elsevier*
Ruuska et al. (2002) Plant Cell 14:1191-1206.
Ryan et al. (1984) J. Am. Oil Chem. Soc. 61:1610-1619.
Saha et al. (2006) Plant Physiol. 141:1533-1543.
Sanjaya et al. (2011) Plant Biotech. J. 9:874-883.
Schaffner (1980) Proc. Natl. Acad. Sci. U.S.A. 77:2163-2167.
Science Publishers Ltd: London (Chapter 2, pp. 48-53).
Scott et al. (2010) Plant Biotechnol. J. 8(8):912-27
Semwal et al. (2011) Bioresource Technology 102:2151-2161.
Senior (1998) Biotech. Genet. Engin. Revs. 15:79-119.
Shiau et al. (2001) Vaccine 19:3947-3956.
Shiina et al. (1997) Plant Physiol. 115:477-483.
Shimada and Hara-Nishimura (2010) Biol. Pharm. Bull. 33:360-363.
Shippy et al., (1999) Mol. Biotech. 12:117-129.
Sieber et al. (2001) Nature Biotechnology 19:456-460.
Siloto et al. (2009) Lipids 44:963-973.
Sizemore et al. (1995) Science 270:299-302.
Slade and Knauf (2005) Transgenic Res. 14: 109-115.
Smith et al. (2000) Nature 407:319-320.
Srinivasan et al. (2007) Planta 225:341-51.
Stalker et al. 1988 Science 242: 419-423.
Stemmer (1994a) Proc. Natl. Acad. Sci. USA 91:10747-10751.
Stemmer (1994b) Nature 370(6488):389-391.
Stobart et al. (1997) Planta 203:58-66.
Tan et al. (2011) Plant Physiol. 156:1577-1588.
Taylor (1997) The Plant Cell 9:1245-1249.
Thillet et al. (1988) J. Biol. Chem. 263:12500-12508.
Tingay et al. (1997) Plant J. 11:1369-1376.
Toriyama et al. (1986) Theor. Appl. Genet. 73:16-19.
Tumaney et al. (2001) J. Biol. Chem. 276:10847-10852.
Tzfira and Citovsky (2006) Curr. Opin. Biotech. 17:147-154.
Ulmasov et al. (1995) Plant Physiol. 108:919-927.
Unger et al. (2002) Transgenic Res. 11:455-465.
van de Loo et al. (1995) Proc Natl Acad Sci USA. 92:6743-6747.
Voinnet et al. (2003) Plant J. 33:949-956.

Volkov et al. (1999) Nucleic Acids Research 27(18):e18.
Wang et al. (2011) J. Agric. Food Chem. 60:144-52.
Waterhouse et al. (1998). Proc. Natl. Acad. Sci. USA 95:13959-13964.
Weinmann et al. (1994) Plant J. 5:559-569.
Weiss (2003) Int. J. Med. Microbiol. 293:95-106.
Weselake et al. (2009) Biotechnology Advances 27:866-878.
Winans et al. (1988) Journal of Bacteriology 170:4047-4054.
Wood et al. (2009). Plant Biotech. J. 7: 914-924.
Wood et al., manuscript in preparation
Yang et al. (2003) Planta 216:597-603.
Yang et al. (2010) PNAS 107:12040-12045.
Yen and Farese (2003) J. Biol. Chem. 278:18532-18537.
Yen et al. (2002) Proc. Natl. Acad. Sci. U.S.A. 99:8512-8517.
Yen et al. (2005) J. Lipid Res. 46: 1502-1511.
Zhang et al. (1999a) Plant Cell Reports 18:959-966.
Zhang et al. (1999b) Plant Cell, Tissue and Organ Culture 56:37-46.
Zhao et al. (1998) Nature Biotechnology 16:258-261.
Zheng et al. (2003) The Plant Cell 15:1872-1887.
Zolotukhin et al. (1996) J. Virol. 70:4646-4654.

SEQUENCE LISTING (448 sequences)

SEQ ID NO: 1 - DNA, 1011 bp, Mus musculus
atgatggttgagttcgctcctcttaacactcctcttgctagatgccttcaaactgctgctgttcttcaatgggttctctctttcttgctccttgttcaagtgtgcatcggaatcatggttatgctcgttctctacaactactggttcctctacatcccttacctcgtttggttctactacgattggagaactcctgagcaaggtggaagaagatggaactgggttcaatcttggcctgtttggaagtacttcaaagagtacttccctatctgcctcgttaagactcaggatcttgatcctggacacaactacatcttcggattccatcctcatggaatcttcgtgcctggtgctttcggaaacttctgtactaagtacagcgacttcaagaagcttttccctggattcacctcttacctccatgttgctaagatctggttctgcttcccactcttcagagaatacctcatgtctaacggacctgtgtctgtgtctaaagaatctctctctcacgttctctccaaggatggtggtggaaacgtttcaatcatcgttcttggaggtgctaaagaggctcttgaggctcatcctggaactttcactttgtgtatcagacagcgtaagggattcgttaagatggctcttactcacggtgcttctcttgttccagttttctcattcggagagaacgatctctacaagcagatcaacaaccctaagggatcttggcttagaactatccaggatgctatgtacgactctatgggagttgctttgcctcttatctacgctagaggaatcttccagcactacttcggaatcatgccttacagaaagctcatctacaccgttgttggtagacctatccctgttcaacagatccttaaccctacttctgagcagatcgaggaacttcatcagacttaccttgaggaactcaagaagttgttcaacgagcacaagggaaagtacggaatccctgagcatgagactctcgttttcaagtgatga

SEQ ID NO: 2 - DNA, 1008 bp, Mus musculus
atggtcgagttcgctccacttcttgttccttgggagagaagattgcagactttcgctgttcttcagtgggttttctcattccttgctcttgctcaactctgcatcgttatcttcgttggactcttgttcaccaggttctggcttttctctgttctttacgctacctggtggtacttggattgggataagcctagacaaggtggtagacctatccaattcttcagaagattggccatctggaagtacatgaaggattacttccctgtgtctctcgttaagactgctgagcttgatcctagccgtaactacattgctggattccatcctcatggtgttcttgctgctggtgctttccttaacctctgtactgagtctactggattcacctctttgttccctggaatcagatcctaccttatgatgcttaccgtttggttcagggctccattcttcagagattacatcatgtctggtggactcgtgtctagcgagaaagtttctgctgatcacatccttagcagaaagggtggtggaaaccttcttgctatcatcgttggaggtgctcaagaggctcttgatgctagacctggtgcttacagacttctcttgaagaaccgtaagggattcatcagacttgctcttatgcatggtgctgctcttgttcctatcttctcattcggagagaacaacctcttcaaccaggttgagaacactcctggaacttggcttagatggatccagaacagactccaaaagattatgggaatcagccttccacttttccatggaaggggagttttccaatactctttcggactcatgcctttcagacagcctatcactactatcgttggaaagcctatcgaggttcaaatgactcctcagccttctagagaggaagttgatagacttcaccagcgttacatcaaagagttgtgcaagcttttcgaggaacacaagctcaagttcaacgttccagaggatcagcatcttgagttctgctaatga

SEQ ID NO: 3 - DNA, 1008 bp, Ciona intestinalis
atgtgggagttcgcccctcttagaatccctatgatcagaagattgcagacccttgctgtttctcacttcgtgttctgtttcttggctcttgctgctacttgcactcttcttactatctatatcaccctcttcaccagctactggcctatcactactgcttacctcgttttcttgttcctcgatcgtaacactcctgagtctggtggtagaagatctgagtgggttagaaactggtctttgtggaagtggatgtctgattacttcccttgtacccttcacaagaccgttgatcttgatcctaagaggaactacatcttcggaatccatcctcatggtgttctctgtatcggatctttcactcacttctctaccaacggatctggattctctcatgttttccctggattcacctcctaccttactatgcttccattctggttcaagatgcctttcttcagggattacgtgatgtctggtggacttactcctgctactaggaaggctatcaagcacactatcactagacctggtggtggacatatctgttgtattatccctggtggtgctcctgagtctcttaacgctagaccaggtgatgttgttcttttgcttaagcagagactcggattccttaagcttgctatcactaacggtgttcctcttgttcctgtgttctctttcggtgatcatgctctttgggagcaaaagcctaaccctcctggatctcttatcagaagattccaggactctagccaaaagtggatgcaagttgctctccctgttttccatgctagaggaatcttccagtacaacttcggactcatcccttacagaagatctgttcacactgttgttggagagcctatcgaagttcctcaaaactctaaccctacctctgaggatctcatgtctcttcaagaggactacatcaacagactcagggctatcttcgatgagcacaagtctaagtacctccctgaggattgcaagctcatcatcaactgatga

SEQ ID NO: 4 - DNA, 1020 bp, Tribolium castaneum
atgaagatcctcggaatcaagttcgctcctcttcatatccctcttgagagaagattgcagactcttgctgctggatgttggttcactactcttgctttcggaactttcatcggaaccttcatctgggtttacgtgttcttcaccaggttctggtacttgtctgttctttacgccaccatcatctacctcgagaagtctaagtgtgagaagggtggtagacctatcgagtggatcagacattggggatggtggtactacctcaagaactacttcccttgcaagctcgatttcgttcctggacttactttcgatcctaagaggaactacctcttcgcttgttaccctcatggaatcctccctgctggacctttcaacactatcggatctccatactctgagttcagcaagcttttcccaaagttcagagtgagactcgttatccttcaccagcatttcttcatcccattccttagagagatcgcttacggaactggtggaatctctgcttctgctaagtctcttaaccacgttctcggatctccagagggaggttacattgctgttcttatgcctggtggtgctgttgaggcttacaactctagacctggacagtacagaatcatcctcaagaacagaaagggattcgttaagctcgctctcagaaacggatctcctcttgttcctgttatctctttcggagagcctgagcttttcgatcaagttgagggaagaaccctcagaaagatccaagagtctatcagaaagtaccttggactcgctcctgttatcttctctggaagaggattcttccagtactctttcggagttatccctcaaagaaggcctatcactactgttgttggacaccctatcgaggttacaaagatcgagaagcctaccaacgaggaagttgacgagcttcacaaaaagtacatgcaagagcttgagaacttgttcgaagagtacaagttcaagtacctcgagaaccctaaggatatccatcttgagttcgagtgatga

SEQ ID NO: 5 - DNA, 867 bp, Danio rerio
atgctcggagccctttacgctggatggctttaccttgatagagatacaccttcttgcggaggtagaagatctcaatgggttagatcttggaggatctggatgcacttcagagattacttccctatcaccctcgttaagaccgttgatcttgatcctaggcacaactaccttctcggattccatcctcatggtgttcttgttgctggtggattcggaaacttctgtactgaggcttctggattctctcaaatgttccctggacttaccccttaccttcttatgcttccattctggttcagggtgccattcttccgtgagtacatcatgtgcggaggacttgtttcttctgagaaggcttctgcttcttaccttcttggacatcctggtggtggacaagctgctgttatcgctgttggaggtgctcctgagtctcttgaggctagacctggtgctcttactcttcaacttcttcagaggaagggattcatcaagcttgctcttaagcacggtgcttggcttgttccagttttctcattcggagagaacgagcttttcgaccaaatggaaaaccctgctggatctgctctcagaagaatgcaagaaagactccagaggattatgggagttgctctcccacttttccatgctaggggagttttccaatactctttcggacttctcccatacagaaagcctatccataccgttgttggtagacctatccctgtttctcaaactccttgcccttctaaagaggatatcgacgctctccacactctctacatgcaaggacttacccaggtgttcgaggaaaacaagaagcactacggaatcgctgatgataagcaccttaagttcacctgatga

SEQ ID NO: 6 - DNA, 762 bp, Danio rerio
atgagggactacttccctatcagacttatcaagaccgctgatctcgacaccagaaagaactacgttatgggattccatcctcacggaatccttgttgctggtgcttttactaacttctgcactgaggctaccggattctctaagttgttccctggaatcaagagcaaccttcttatgcttcctctttggttccgtgctccattcttcagagactacatcatgtctgctggactcgttccttctgacaaagagtctgcttcttacctccttagaagaaagggtggtggaaacgctgttgttatcgctgttggaggtgctcctgaggctcttgatgctcatcctggtgattacactgttcaccttgctaacaagaagggattcatcaagcttgctatcgagcatggtgctgatcttgttcctatctactctttcggagagaacgaggttttcgatcaagttcaaaaccctagaggaacctggcttcgttacatccaagaaagactccagaggattatgggagtttctcttccacttttccacgctaggggagttttccagtacactttcggacttatgccttaccgtaagcctatcaacaccgttgttggtagacctatccctgttgagaagaacgagaagcctactgctgaggaacttgatgtttaccatcagcgttacatggatgagcttgctagacttttcgaggatcacaagggaaactacggtgttcctgaggatactcatctcgttttccagtgatga

SEQ ID NO: 7 - DNA, 1093 bp, Homo sapiens
cgtgggtgcaggctgcagtggctggcgccgtcctcgcccggccaggccatgaaggtagagtttgcaccgctcaacatccagctggcgcggcggctgcagacggtggccgtgctgcagtgggtcctttcttttcttacagggccgatgtccattggaatcactgtgatgctgatcatacacaactatttgttcctttacatcccttatttgatgtggctttactttgactggcataccccagagcgaggaggcaggagatccagctggatcaaaaattggactctttggaaacactttaaggactattttccaattcatcttatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgatgagtgttgggctggtttcagtttccaagaaaagtgtgtcctacatggtaagcaaggagggaggtggaaacatctctgtcattgtccttgggggtgcaaaagaatcactggatgctcatcctggaaagttcactctgttcatccgccagcggaaaggatttgttaaaattgctttgacccatggcgcctctctggtcccagtggtttcttttggtgaaaatgaactgtttaaacaaactgacaaccctgaaggatcatggattagaactgttcagaataaactgcagaagatcatggggtttgctttgcccctgtttcatgccaggggagtttttcagtacaattttggcctaatgacctataggaaagccatccacactgttgttggccgcccgatccctgttcgtcagactctgaacccgacccaggagcagattgaggagttacatcagacctatatggaggaacttaggaaattgtttgaggaacacaaaggaaagtatggcattccagagcacgagactcttgttttaaaatgacttgactataaaaaaaaattaaaaaataaaaataaatgac

SEQ ID NO: 8 - DNA, 1008 bp, Mus musculus
atgatggtcgagttcgcgccactcaacaccccgctggcacggtgcctacagaccgctgcggtgctgcagtgggtcctgtccttcctcctgctcgtgcaggtgtgcattggaattatggtgatgctggtcctgtacaactattggttcctttacatcccatatctggtctggttttactatgactggagaaccccagagcaaggaggcagaagatggaactgggtccaaagctggcctgtgtggaagtattttaaggagtattttccaatctgtcttgtcaaaacgcaggatttggatccgggtcacaattatatatttgggtttcaccctcatggaatattcgtgcctggagcctttggaaatttttgtacaaaatactcggacttcaagaagctatttcctggctttacatcgtatctccacgtggccaagatctggttctgtttcccgttgttccgagaatatctgatgagtaacgggccggtttcagtgtctaaggagagtttgtctcatgtgctgagcaaggatggaggtggcaatgtctcaatcattgtcctcggaggtgcaaaggaggcgctggaggctcacccaggaacattcaccctgtgcatccgccagcgcaaagggtttgttaagatggccttgacccatggtgccagtttggttccagtattttcttttggtgaaaatgatctatataagcaaattaacaaccccaaaggctcctggctacgaactatacaagacgcaatgtatgattcaatgggagtagccttgccactgatatatgccagaggaattttccagcactactttggcataatgccctatcggaagctgatctacactgttgttggccgccctatccctgttcagcagattctgaacccgacctcagagcagattgaagagctgcatcagacatacctagaggagctaaagaaactattcaatgaacacaaagggaaatatgggattccggagcacgaaactctggtatttaaataa

SEQ ID NO: 9 - DNA, 1093 bp, Pan troglodytes
cgtgggtgcaggctgcagtggctggcgccgtcctcgcccggccaggccatgaaggtagagtttgcaccgctcaacatccagccggcgcggcggctgcagacggtggccgtgctgcagtgggtcctttcttttcttacagggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatgacttgactataaaaaaaaatttttaaataaaaataaatgac

SEQ ID NO: 10 - DNA, 1008 bp, Pan troglodytes
atgaaggtagagtttgcaccgctcaacatccagccggcgcggcggctgcagacggtggccgtgctgcagtgggtcctgaaatacctgctgctcgggccgatgtccattggaatcactgtgatgctgatcatacacagctattcgttcctttacatcccttatttgatgtggctttactttgactggcataccccagagcgaggaggcaggagatccagctggatcaaaaattggactctttggaaacactttaaggactattttccaattcatctcatcaaaactcaagatttggatccaagtcacaactatatatttgggtttcacccccatggaataatggcagttggagcctttgggaatttttctgtaaattattctgacttcaaggacctgtttcctggctttacttcatatcttcacgtgctgccactttggttctggtgtcctgtctttcgagaatatgtgctgagtgttggcctggtttcagtttccaagaaaagtgtgtcctacatggtaagcaaggagggaggtggaaacatctctgtcattgtccttgggggtgcaaaagaatcactggatgctcatcctggaaagttcactctgttcatccaccagcggaaaggatttgttaaaactgctttgacccatggcgcctctctggtcccagtggtttcttttggtgaaaatgaactgtttaaacaaactgacaaccctgaaggatcatggattagaactgttcagaataaactacagaagatcatggggtttgctttgcccctgtttcatgccaggggagtttttcagtacaattttggcctaatgccctataggaaagccatccacactgttgttggccgcccgatccctgttcgtcagactctgaacccgacccaggagcagattgaggagttacatcagacctatatggaggaacttaggaaattgtttgaggagcacaaaggaaagtatggcattccagagcacgagactcttgttttaaaatga

SEQ ID NO: 11 - DNA, 1008 bp, Canis familiaris
atgaaggtcgagtttgcgccgctccacatcccgctggcgcggcggctgcagacggccgcggtgctgcagtgggtcctgtccttcctgctgctcgcgcaggtgtgcatcggaatcatcgtggtactgatcgtgcacaactattggttcctctacgtcccttatctgacatggctttgccttgactggcggaccccagagcagggaggcaggagatccaactgggtcagaagctggaccgtttggaggtattttaaggactattttccaattcacctcatcaaaacttgggatttggatccaagtcacaactatatatttgggtttcacccccacggagtgcttgttgctggagcctttggaaatttttgtacgaatcattcagacttcgaggagctgtttcctggcttcactgcgtatcttcacgtgctcccattttggttccggtgtcctctctttcgagaatatctgatgactagcgggtcagtctcagtttctaagaaaagtgtgtcctatgtgctgagcaaggagggaggtggaaacatttcagtcattgttcttgggggtgcagaagaatcactggatgcccatcctggaaaattcactctgttcatccgccagcggaaaggatttgttaaagtggctttgacccatggtgcctccttggtcccggtgttttcttttggagaaaatgaactatttaagcaagttaacaaccctgaaggctcatggcttcgaactgtgcaggagaagctacagaagatcatgggatttgctttgcctctgttccatgccagagggatttttcaatacaattttggcctgatgccctataggaaacctatccacactgtggttggtcgcccaatccctgttcatcggactccgcacccaagcccgggacagattgaggagttgcatcagacctatatggaggagctaaggaaattatttgaagcacacaaaaggaagtacggtattcccgagcatgaaactctcatttttaaataa

SEQ ID NO: 12 - DNA, 1118 bp, Bos taurus
atgaaggtcgagtttgcgccactcaacatcccgctggcgcggcggctgcagacggctgcggtgctgcattggttgctgtccttcctgctgttcgcacaggtatgcctcggaattatcgtgttcctgatcatatacaactactggttcctctaccttccttacttgacatggctttactttgactggcaaaccccagagcaaggaggcagaagatctgaatgggtcagaaactgggccatttggaggtactttaaggactattttccaattcatctcatcaaaacctgggatttggatccgagtcacaactacatatttgggtttcacccccatggagtgcttgtggttggagcctttggaaacttctgtacaaattattcggccttcaaggagctgtttcccggctttacctcctatcttcacgtgctgccgtattggttccggtgtccgctcttccgggaatatctgatgagcagtgggccagtctcagtttccaagaaaagtgtgtgccacgtgttaagcaaagagggaggtggaaacatctcagtcattgtgctcgggggtgcagaggaatcactggatgcccatcctggaaagttcactctgttcatccgccagcggaagggattcgtgaaaattgctttgacccatggtgcttatttggtgccagtgttttcttttggtgaaaatgaactatttaaacaagttagcaatcccgaaggatcatggcttcgaaatgtgcaggagaaactacagaagatcatgggatttgctttgccactgttccacgccagaggaatttttcaatacaattttggcctaatcccctataggaagcccattcacactgttgttggccgcccaatccctgttcgtcagaccctgaacccaacctcagagcagattgaggagttgcatcagacctacatggaggagctgagaaaattatttgaagaacacaaagggaagtatggtattccagaaaatgaaactctcatttttagataactgttgtcttagaagtcatgcaagagagcgagagaacatcccactgaaagaaaagatattctaaataaatttttttctttgacaatggaatcaaatttgcaactgtaaaa

SEQ ID NO: 13 - DNA, 749 bp, Rattus norvegicus
ttgactcactaagggccagtttcagtttctaagaggagtttgtctcatgtgatgagcaaggaaggaggtgggaacatctcagtcattgtcatcgggggtgcgaaagagctactggagtccttccctggaagatattctctgtgccttcttcagcgcaaaggatttgttaagatcgccttgacccatggtgcccatttggttccagtgttttcttttggtgaaaatgaactatatagccaagtcgacaaccctaaaggctcatggcttcggactgcccaagacaaagtgtataacctaacggggttggccttgccactattctatgccagaggaattttccagaacagctttggcctaatgccctatcggaaattgatctacactgttgctgcggttggcacagcagctcgtttgactcagaagtcaaaccatcagaacgacagctcagtgtctgctgagaagggaaactcttttatttgttgtcaagtgggatggtgtgaccgagataggcagccattggccgccccatccctgttcagaagactctgcacccgaccccagagcagattgatgagctgcatcagacgtacatggaggagctaaggaaactcttcaatgaacataaagggaaatacggtattccggagcatgaaactctggtttttaaataaccgtcttcctccaagccatactgaaggaagacaagaaaacattgttgagaaaataaatattttaaataacttctctgt

SEQ ID NO: 14 - DNA, 1547 bp, Danio rerio
ttttttttttttttttcctgtttgagctgtctttattatcgtcctcgccattgagttcgctcctctgcgcgtgcctctgcgcaggcgcattcagacggccgcggtggtccagtgggtcttcagcttcttggctctggctcaggtgtgtctggccgcgttcgtgctgctgtgtctcagtgattggtggatgctcggagcgctgtatgctggttggctgtatctggaccgggacacgccctcatgtggaggtcggaggtcacagtgggtcagaagctggaggatctggatgcatttcagggattatttcccaatcacactggtcaagacggtggatctggacccgaggcacaattacctgctgggtttccatccgcacggtgttctggtggccggtggattcgggaacttctgcacggaggcgtccggattctcccagatgttcccgggactcacgccgtacctgctgatgctgccgttctggttcagggtgcccttcttcagagaatacatcatgtgcggagggctggtgtccagtgagaaggccagtgcgagttacctgctgggtcatccaggcgggggtcaagcggccgtcattgcagtgggcggagctccggagtctctggaggcgcggcctggagcactgacactgcaactgctgcagcgcaaaggcttcatcaaactcgccctcaaacacggagcgtggctggttccagtgttctcgtttggggagaacgagctcttcgaccagatggagaatcccgcaggctccgccctccgccgcatgcaggaacgcctccagaggataatgggcgtggctttgcctctctttcatgctagaggagttttccagtacagcttcgggctgctgccgtacaggaaacccatacacaccgtcgttggacgtcccattcctgtaagtcagactccgtgtcccagtaaagaagacatcgacgctcttcacacactctacatgcagggcctgacacaggtgtttgaggagaacaagaaacattacggcatcgcggacgacaaacatctgaagttcacctgaactgatctgtgtgtgtgtgtgcgcgtgcgtatgtgtttgtttgtgtgtgtgtgtgtgtgtgtgtgtgtgcgttgcatataatctagaatgattatctaccatctagttaaaggtcttggtacgaggggttgtgtagttgtgttgtcatgtgatatgacgatattcagaataacccacagcttgagctgaagtacggttactacacagtgtataaaacattaaggagatccttttactgttatcctccttcactacagtatggtaaatattgttactgtattttatgacttcattaaaacactatgtgaccgccattaagattattaaatgttcagattaaacaggtcatgaacactctgggttttacagatcttcaggattccctcctgtgcttaaatcagatttgttcttaatcagcaaatgtgtgttgatgtgtatgacaacagaaacacaaataaagcggtgctgtttattattttaaaaaaaaaaaaaaaaa

SEQ ID NO: 15 - DNA, 1279 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaaatattatctatttaatcacgtttgatgcacttttctcatatttacatctctattatacctcattctgcaatttagttcatattttcagccaatttttcaatattacgagttctcatgtcaaatatccccatcagattcagttactagttcagttatttttaatcgatctctattataagtttcgacacag

SEQ ID NO: 16 - DNA, 1089 bp, Caenorhabditis elegans
attcttcattggacctctacgaccaccacacagtcagtcatgttagatcgaacagaaagtgaagataagatgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaa

SEQ ID NO: 17 - DNA, 1149 bp, Caenorhabditis elegans
tcagctttccactgaaaatgccgcaatttctcggaatagaatgggtggatctattctcatcaattcaacgtaaaaagacatacttgggagttgtctatcactttatgctcacttacccacttgcacttttcgtcaccattttgccatttttcttgcttttcactttccaatggcacattttggctctctacgcttgctggtacttctacgatatggattctccgaggagaggtggatattccagtgattgggtcagaaaatggcgtgtcaacgactggttcgcccaatacttcccaatcaacttgcacaaaactgccgaactctccacggacaagaactatctggttggaatccatcctcatggtatcatctccatggctgcatggtctaattttgccaccaatggaacgggaatctatgagaaattccctggaattcgctggaatttgtgcactttagcacttcagttcagaatggccatccgtcgtgagcttctccttctcaccggcctaatcgactgctccagagaatccattgaatatgtgcttgacaaatgtggccagaagggacgtgcagtggtattggtgattggaggagccgaagaagctttagatgctcatccaggctaccacacactcactttggcatcaagaaagggatttgttcgggaggctttgattactggtgcctacttggtcccggtgtattcttttggagagaatgacgtttttgaacagatggagaatccagttggctcacggctccgcaacttccaagaatggtgcaaaagcattttcggcatctcatatccaattttccatggtcgtggcttcttccaactaactttcggatatcttccattccgtaaaccaatcgataccgtagtcggagccccaattcccgttgaaaaagtggaaaatccgacgaaagagcaaatcgacgagcttcacaccatttattgtcaaaagttgacggagctgttcgatgagcacaaggaaaaatatggagtggagaaggacgtgccgttggtgctccggtagagcggaaaatttgaaatgttctgtgaaaagtgccagtttttgatgagatttctgtattttatcgtgccataatttttgtttttcgagccttgttttaagttgttacggt

SEQ ID NO: 18 - DNA, 1136 bp, Caenorhabditis elegans
atgctaaactaccaaattcacaaaaagctcaccgacatcaagtgggtgaacatcttctccccatgggatcgccagcgtgcctacttcgccttggtcgtctggttcgggctcatctacccattctgctgcctgtgccaggtggctccgtttgtgctctttttcaccggccagtggattattttgggtctctacgcagtttggtacctttacgatcgagaatctccgagaagaggaggatatcgggataattggttcagaaatttgtcgctgcacaagtggttcgccgagtattttcctgttaaacttcacaaaactgcggagttggatccaaaccaaaattatttattcggatatcatcctcatggaattctcggtgtcggagcgtggtcttgttttggatttgatgcgtgcaatgtgaagcaagtgttcaaaggcatccgcttcaacatctgcaccttgcccggcaacttcaccgcaatgttccgccgcgagatcctcctcagcatcggtatgatcgagagctccaaagaatccatcgagcacgtgctcaactccgaggaaaagggccgtgccgttgtaattgtcgtgggtggagccgctgaagctcttgaagctcacccagggaagcatactctaacactggcaaatcgcaaaggtttcgtgagagaagccgtgaagaccggagctcatctggtgccagtttatgcgtttggagagaatgacatatataagcaaattgacaacccggaaggctcgaaattacggaaaattcaagaatggggaaagaagaaaatgggaatttcactgccactaatctacggaagaggatattttcaaatggctcttgggcttcttccaatgagccgagctgtgaatgtagttgtcggagcgcctattcaagtggaaaaagagctcgatccttctaaggaagtcattgatgaaattcatggagtttatatggaaaagctcgccgagttatttgaagagcacaaggcaaagttcggagtttccaaggacactcggctcgtttttcagtgaaataacttttattttagattatttgtttgatgtttgatgtctgttatgttatcattttttatcaccaaatcgtgtaattttgtttacgggttcattac

SEQ ID NO: 19 - DNA, 1176 bp, Caenorhabditis elegans
atgagactccggctgagctcgatatctggaaaggcgaagcttcccgataaagaaatatgctcatcagtttcgagaatattggcaccattgcttgttccatggaagcgacgactcgagactcttgccgtgatgggtttcattttcatgtgggtaatcctaccaatcatggacctctgggttccattccacgtcttgttcaatactcgatggtggttccttgttccactctacgctgtctggttctactatgattttgatacaccgaaaaaagcttcaagaagatggaattgggccagaagacacgtagcctggaagtactttgccagctacttcccattgagattgatcaagactgctgaccttccggcggatcgtaattacatcattggctctcatcctcatggaatgttctcggttggtggttttactgcaatgagcaccaacgcgaccggatttgaagacaagttcccgggaataaaatctcacatcatgacgctaaatgggcaattttatttcccatttcgtcgagaattcggaataatgctcggtggaatcgaagtttcgaaagaatcacttgaatacactctaactaaatgtggaaaaggacgagcatgcgcaattgtcattggcggagcctcggaggctcttgaagctcatcccaataaaaatacattgacgttgatcaatcgacgtggtttctgcaaatatgctctgaagtttggagcagacctcgtaccaatgtacaatttcggagagaatgatttatacgagcagtatgaaaacccgaagggatctagattgcgagaagttcaggagaaaatcaaggacatgttcggattgtgtcccccattgctccgcggtcgatcgttgttcaaccaataccttatcggattgctgccgttccgaaaaccagttacaacagtcatgggaaggccaattcgagtcacccaaaccgacgagccaaccgttgagcagattgatgagctgcatgcaaaatattgtgatgctctctacaatctgttcgaggagtacaagcatcttcactccattcctcccgacactcatctcatcttccagtgactttttcacaaattttgtatattttgcacacagattgttttatcgccaagttaatgtatagtaatcttcttgtaaataaatcagataaacattaaa

SEQ ID NO: 20 - DNA, 1239 bp, Kluyveromyces lactis
atgggtaaggaacaaatcagaaagagacaaactaaaaaggtacgcaagggttcacaacccgtggcaaatggtaaatcttctgtagtaggggtctccaaagatgggaaaccagaattttgtgctattgatacgcccatagaaaggagacttcaaactctcagcgtagcatggtatgtcgaatgtattccgttaatgatcatcataatgttgtttgtttgggttaacccgttgatgtggtcgtttgtaataccatacaccatttattatttcatagaccggactgcctccaatgggaacgctgtgaagagacactccaagtggttccgatctctaaaggtctggttttatttccgtgattacttccctataagtatgcacaaaagcactgaactcgagccaacatttacaagtattgattccacagagctggaaaatgatgcgagtgagccaggctacctggatagctcacagcccgttttaccagataaatggtggaatcctttcagagaaaaggatgaaactgttagaccaacaggaccgaggtatatttttggctaccatccacatggtatagcagcattcggagcgtttggagcattcgctaccgaggcatgtaattggagtaaagttttcccaggcattccagtgtgtttgcttactttggtaaatcaatttcaaataccagtgtaccgtgattatttattggccttaggcataacatcggtcgctagaaaaaatgctatgaaagtacttgagaaaaattattcaatagccatcgtaattggaggtgccagtgaatcccttcttactaaccttggttcatctgatatcattttaagcaagcggaaaggttttgtgaagttggctttgcaaactgggaatgtgagtcttgtacctgtgtatggatttggtgaaactgatacttacaagattctgaagcttaaaaatgactctataataggcaggatacagatatggcttaaagagaactacagcttcactgtccctctatttttcgctcgtggtgtattcaattatgattttggtttactaccgtttagacatccagtcaatgttgttgttggaaaccctattcatattaaagaaaagatagatcatccaacaattgaggagattgatcattaccattccttatacattgaagaattgaaacgtctttacgatgataacaaggcaaaatttaactattcagaaaaaactttaaatatagtggaatga

SEQ ID NO: 21 - DNA, 1386 bp, Ashbya gossypii
atgcaggacagcatggatgacagcttgagggaggctgagggcagacaggacgactcggaggtcagcagcgggacgacactcggaagcagcaccccggaggacagcggggtgacggcgaagctgcgcaagaagtaccagatggcgtcggcactgctgcggcgggagctggaggagctgagcgtgtacgacgcgaagacggcgggggtaagcggccgcagcagcggcagcggcagcggcgggctggcgctgctgggcgggcgattccacgtggcgccgctgcggatccccgcgcggcggcggctgcagacgctggtggtggcgtggcacacgagctcgttcatctacatgacggtgctggtgctgtttctggcggcgaacccgctgatgtggtggttcatggtgccgtatatggtgtactacgtgtggaaccggtcgccggcgaacggcggagtggtgcggcggtactcgccgcggctgcggtcgctggcgctgtggcggtactactgcgagtactacccgatctcactgcacaagagcgaggacctggcgccgacgttcgtgccggacccgcggggggcggagccgcgcgagtggaagctgcggctgtggctgtggccgacgcgcgtggagctgctgaacttgacgctccagtggacgcgcgcgcggccgcaggttgcgacagggccgcgctacatcttcgggtaccacccgcacggcgtgggcgcactgggcgccttcggcgcgatcgcgaccgagggctgcaactggagcaaggtcttcgcgggcatcccggcctgcctgtgcacgctggtgaaccagttccagatccccatctaccgcgactacctgctgggcctcgggtgcacctccgtggcccgcaagaacgtgctcaaggtgctcgagcagaactactcggtctgcatcgtcgtgggcggcgcccaggaagccctgctcagccgtgtgggctccaccgagctcgtgctgaacaagcgcaagggcttcatcaagctcgcgctggagacgggcaacgtcaacctggtgcctatctacgccttcggcgagacagactgcttcaacgtgctcgacacgggcaacgagagctacctacgcaagttccagctgtggatcaagaagacctacggcttcaccatcccgttcttttttgcgcgcggtgtcttcaactatgacttcggcttcctgcccttcaggaatccgatcaacgtcgtcgtgggcaagcctgtgtacgtagacaagcgcagaacgaaccccaccatggaggaaatcgaccactaccacgacctgtacgtgcaggagctgcgcaatgtgttcgacaagaacaaacacaagttcggctacgccgggaaggaacttaaaatagtagagtag

SEQ ID NO: 22 - DNA, 1653 bp, Magnaporthe oryzae
atggccacggtagatgatacccagaaccatgtccaactgaatgcagagtccagcctaaacgaatttccgtaccaagcaagcgcggacaaggaggagtatccaagccttccttctgccccgctccctgacgtggacggcagctcccaaaatgggcatacagccgccaacgctgaccttccgccctcggagtcgaccgaacagccatggaacaaggtagccagtggcgacttcatccatgaaaccaagatgcccagtgaagaccgggacaaccttgccaggcccggcagtctaccaactcccgagccgagccgtagaggcagcaacacgctggtcggcagcccgcgtcagggcgacggattgcaaatgctcatggacgaattcgcagacgatgaatcctcagatacctcgtgggacattcacgagaccatcaggagtcgcacccaggccttggctgagaaggaccaccaggggatattctcaaatcagcggcgaggcaaccaggccgacgcgccagacacggtaaccagtgccaacgcttggttgccggctggcttcgaagacgacctggacgaagtgaccggtgctgacgacgagttcgagccaacccgtgggagtcgctggagagtgaggctggcgcccctggataccccttttcatcgccggatgcagaccctggtggttctgctacacgtcctcggcatgggaatcactttcagctttttctgcttcctatgcacgctccccctgttttggcctatcatcatcgcctacctcgtattcatcagactgtcgagagctggatccgatgggaagacaaaccgtcgcatagaatggctccgcagggctcgcatctggaagtactttgccgattacttccctgtcaagctacacaagacagccgacctgccccccacccgcaagtacatttttgcgattcatccacacggaatcatctcgcatggtgcctttgcctccttcgccacggaggccctcggcttctctgagaagtttcccggcatcacaaacagtgtgtgcactcttcacggcaacttcaagaccccgttctaccgcgagtatctgatggccatgggcctgatctcggtttcaaaggagtccattattaacactttgatgaccggcgggatcaacggtgaaggcatgggcagggccgtctccataattgtcggtggggcgcgagaggcactcgaggcctgccccaagacgatgcgcttgatactgaaacggcggggtttttgtcgcatggcactacgcaccggtgcagaccttgtgccggtgctctgctttggtgagaacgacctctaccaacagtgggggccgcaggatcatccgcgcttccgtcgcctgcaaatgaaggctctcgcgtacctaggctttgcggtccccgttctgaggggaaggggcgtcttcaactatgactttggagtccttcctcagcggcggccgatcaacgttgttgttggtgagcctatcaaggttgagcagtttcggggtagcggtaacattgagccacgcgtcgaggagctgtggaagctatattgccagaagcttcaggaactgtacgaccagaacaagcacgtctatttcaaggatcgtcaggaggatatgaggtttgttgactcggaggagttgtaa

SEQ ID NO: 23 - DNA, 1410 bp, Ciona intestinalis
gccataaaacgttgagaaaatgttttgtgttacgtcaagttactcattaactcaatgtaaagattgatatagccagagcaaattgtagttaagtagcgcatatacccaacttggaaactgctatatagttggtaaagcggattaggaaccatgtgggaattcgcaccgcttcgtattcctatgataagaagacttcaaacgttggctgtttctcattttgtgttctgctttcttgccttagctgccacatgcactttattgactatctacattactttgttcacttcatactggccgatcaccaccgcttaccttgtgttcttattcttggaccgaaacaccccggaatctggtggaagaagaagcgagtgggtgagaaattggagtctctggaaatggatgagcgattactttccttgtacgttgcacaaaaccgttgacctcgatccaaaaagaaactacatatttggcatccatccacatggggttttgtgcatcggatctttcactcacttctccacgaatggctccggattttcgcacgtttttccgggatttacatcttatcttacgatgttgcctttctggttcaaaatgcccttttttcgtgactatgttatgagcggcggtttgactccagccacaaggaaagccatcaaacacacaataacaaggccaggtggtgggcatatatgctgcattatacctggtggtgctccagaatctctaaacgcacggcctggagatgttgtattgttgctgaaacaaagacttggatttctcaagctggcaataacgaacggagttcctttggttcccgtgttttcatttggcgatcacgcgttgtgggagcagaaaccgaatccccccggttccctcatccgtaggttccaagatagctctcagaagtggatgcaagtcgctcttcccgttttccacgcacggggtatctttcagtacaattttggactaattccgtacaggcgtagcgtccataccgtagtgggcgagcccatagaagtgccacagaacagtaacccgacatcggaggaccttatgagtttgcaagaggattatattaatcgattgagagcaatttttgacgagcacaagagcaaatatctcccagaagattgcaaactgatcatcaactaaactaaactaaactatgcaaccaaagctttttaaattgagttagttatagtagtgtgaagtaagatagagcacctttagcaataatgctgtccaaatttcctggttcaaacaattaataacggacgggagtcgtgatgaaacggttttagaatactttaagtgtttttgtttactaccaaatgaaaagataaggtagaataaaagggtgtctcatcttcccccaccgtactatatatatacacgatcgaatcattg

SEQ ID NO: 24 - DNA, 1005 bp, Homo sapiens
atggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctga

SEQ ID NO: 25 - DNA, 1728 bp, Mus musculus
agcatggtggagttcgcccccctgttggtaccatgggagcgcaggctacagaccttcgcggtccttcagtgggtcttctccttcctggccttggcccagctctgcatcgtcatcttcgtaggcctcctattcacaaggttctggctcttctctgtcctgtatgccacctggtggtacctggactgggacaagccgcggcagggaggccggcccatccagttcttcagacgcttggccatatggaagtacatgaaggattatttccctgtctctttggtcaagacagctgagctggacccttcccggaactacatcgcgggcttccacccccatggagtcctagcggctggagcctttcttaacctgtgcactgaaagcacgggctttacctcgcttttcccgggcatccgctcctatctgatgatgctgactgtgtggttccgggcccccttcttccgagattacatcatgtctggggggctggtctcatcagaaaaggtgagtgccgatcacattctgtccaggaagggcggcgggaacttgcttgccatcatcgttgggggcgcgcaggaggcactggacgccaggcctggagcctacaggctgctgctgaagaatcgcaagggcttcatcaggctcgccctgatgcatggggcagctcttgtgccaatcttctcctttggagaaaacaacctgttcaaccaggttgagaacacccctggtacctggctgcgctggatccagaaccggctacagaagatcatgggcatctccctccctctcttccacggcagaggtgtcttccagtacagctttggcctcatgcccttccgccagcccatcaccaccatagtggggaagcccatcgaggtgcagatgacaccacagccctcaagggaggaggtggaccggcttcaccagcgctatatcaaggagctctgcaagctctttgaggagcacaaactcaagttcaacgtccctgaggaccagcatctggagttctgctaagtgtctccagccggaagacagctgcatctgagcgcctgcaggagtgtgggattagggggacttccacagccaccagacactcctacaaacctagccacaactgccaagatggaagagggggcagctcctaatcctgggatttgaacctgcagccaaagctctgaggtctccctgtccttggcctgtctgcacatctgtagaatgggggaaaagcaggcagagagaaattcctgaggtctcttcccacagttgtaatgtcattcaaacatgaccaaaggacaaacagggagaaagagaacaaaactgttcttcatctacccttgagggacagtgcaagagaagccagcaccccaggcctccctgtgcatgctccctgatgctgcttcttccctctgaggcagagacggggagccaagtctgccctggcacctactctatgtttcttcagattctgggtcctctgagctatgataccaaaggagcccagaaggcagataaggagggcaggggtcactgactatgaccgagggtaggtctccttcccatatcctgagcctcagtttccccagccttaatgacctgggagcgccacactgctcaccacagaggctccaccagagagcctcttactcatgctttctagtgaactccagcctctgtcttggcactgaagggcagcactgtacatgttacctcaataaatgaaaggagtctgtctta

SEQ ID NO: 26 - DNA, 1128 bp, Pan troglodytes
aaaaacctgtgggtgcctcagaccacagcagagctcacagaacctgcgggagccaggctgacccgccagcatggtagagttcgcacccttgtttgtgccgtgggagcgcaggctgcagacacttgctgtcctacagtttgtcttctccttcttggcactggctgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggtttctcttcgatcttccccggtatccgtccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctgagcccaaagggcagggccaacattagggagcccagcaggaggtgctgtgctgag

SEQ ID NO: 27 - DNA, 1005 bp, Canis familiaris
atggtgaagtttgcaccactgttcgtgccatgggagcgcaggctgcagaccttcatggtcctgcagtgggtcttctccttcctggccctggcccagatctgcactgtggtcttcgtaggcctcctgttcacaaggttctgggtggtcagcgtcctgtatgccgcctggtggtaccgggaccgggacacgccgaggcaggggggcaggcccgtccaagccctgaggcgctgcttcttgtggaagtacatgagggactacttccccgtcacgctggtcaagactgctgagctggacccctcccggaactaccttgctggcttccacccccacggggtcctggccgcaggagcctttgtcaacctgtgcacggagagcacgggcttccctttgctcttccctggcatccgctcccatctgatgatgctgaccttgtggttccgggtccctttcttcagggattacatcatgtccgggggcctggtcacttcggacaaggagagcgctgctcacatcctgagcaggaaggagggtggcaatctgctggccatcattgtagggggtgcccaggaggcgctgaacgccaggcctggagactccacgcttctgctccggaaccgcaagggcttcatcagacttgccctgatgcacggggcagctctggtgccgatcttttcctttggggagaatgagctatttgaccaggttgagaactctcctggctcctggttgcgtaggattcagaaccggctgcagaagatcatgggtatctccctcccgctcttccatggccgtggtgtcttccagtacagctttggctttataccctaccgccagcccatcaccaccgtggtgggaaagcccatcgaggtgcagaagacactgtgtccctcaaaggaggaggtggacaagctgcatcagcgctatgtcaaggaactgtgtgaactcttcgaaacccacaagctcaagtacaatgtccctgtggaccaacatttggagttctgctga

SEQ ID NO: 28 - DNA, 1820 bp, Bos taurus
gaggagccagcatggtggagtttgcacctttgtttgtgccactggagcgcagactgcagacctttgcagtcctgtactggatcttctgcttcatggtcttaccccctttatgccttgtggtcttcataggcctcctgttcacaagattctggctcttcaatatcctgtatgtgatctggttgtacttggaccaaaataggccacggcaggggggcagtcacaataagttcctaaagcgctgggtcctgtggaagtacatgaaggactatttccccatcacgctagtcaagaccactgagttggacccctcccggaactaccttgctgccttccaccctcatggactcctgtcagtcggagcttttaccaacatgtgcacagacagcacgggcttctcctcacttttccctggcatccgcccacatctgacaacgataaacatatatttcaggatcccactcttcagagattacatcatgcaaggggggctggtctcatcagacaaggagagtattgcttacattctgagcaggaaaggaggcggcaacctagtggccatcactgttgggggcatcagggaggcactgaaaaccaggcctggagccaacaagctggtgctgcggaaccgcaagggcttcatcaggctcgccctgatgcatggagcagttctggtgccgatcttctcctttggggacaatgaattatatgctaagacttctcctggcttttggtggaaatggttcagagatcaactgtacaagaagacacgtcttgccatcccgttcttctatggccgtggagtcttccagtacagttttggttttatgccctaccgccgacccatcaccaccgtggtggggaagcccatcgaggtgccgaagataccacatccctcccaagaggaggtggacaggctgcaccagcattacctgaaggagctgagcaacctcttcgaaacccacaagctcaagtacaacatccccaaagaccaacacttggagttctgctgagtacctccccagaggaggggcttgccccaaagggcagggctggcattaggaagggaggtgctgtgatcccagaaggtttcctggaggtatctgttgaacacatctccagagccttcactgactcctgcatctccaccccatgccaggccccaggtcacatctggctcatagaagaggagaccagactctggcatcaatgatttgctctcctccactaactcctctgtaacgggccctctctttggttctgcccacctgagaaatgggagagatactgggagaaaatgctgtctgtgtgtccgtcctctgtggtcctgtcactcaataagcaggacaaacagcagctccagtgagcaggtttcccttcctctgccttgagtgacagctggaagcagcccccagctgcagccctttctcctacaagctcccttatcctacatcctgcctgtcccatcttctccctccctgagccggagaggagggggagggcacaacctcctggctcatcctggcacctctgagtttctgagccccatatggcagccagaagggcctggaggtggggaagacctgagctctgtcactggctaaatgactgtacaccaacctcttcaacctccctctgagtctcagttttcccaaggactaaaatgacctctgacctcggctctaatcacacataggctgaaagctgcttatggtaactcctactctatcctttgtaattcagccctgaccttgggctccatatatgtcaattcatcacatgaaagattcgattttaaaaaaaaaaaaaaaaaaaaaaaaaaa

SEQ ID NO: 29 - DNA, 1774 bp, Rattus norvegicus
gtgtgtggagcctcctgagccagctcagcatggtggaattcgcccccctgttggtaccatgggagcgcaggctacagaccttcgcggtccttcagtgggtcttctccttcctggccttggcccagctctgtatcttcatcttcatcggcctcctattcacgaggttctggctcttctcagtcctatatgccacctggtggtacctggactgggacaggccgaggcagggaggccggcccatccaattcttcagacgcatggccatatggaagtacatgaaggatttcttccctgtctctttggtcaagacagctgagctggacccttcccggaactacatcgcaggctttcacccccatggagtcctggcggccggagcctttcttaacctgtgcactgaaagcacaggctttacctcgctcttcccaggcattcgctcctatctgatgatgctgactgtgtggttccgggcccccatcttccgagattacatcatgtctggggggctggtctcgtcagaaaaggtgagtgctgatcacattctgagcagaaagggcggcgggaacttgctagccatcatcgttgggggcgcacaggaagcactggatgccaggcccggagcctacaggctgctgctgaagaatcgcaagggcttcatcaggctcgccctgacacatggggcagctcttgtgccgatcttctcctttggggagaacaacctgtttaaccaagttgagaacacccctggcacctggctgcgctggatccagaactggctgcagaagatcatgggcatctcccttccgctcttccatggcagaggtgtcttccagtacagctttggcctcgtgcccttccgccagcccatcaccaccgtagtggggaagcccatcgaggtgcagatgataccacatccctcggaggaggaggtgaaccggcttcaccagctctatatcaaggagctatgcaagctctttgaggagcacaaactcaagttcaacgtccctgaggaccagcatctggagttctgctaagtgtctccagccggaagacagctgcatctgagcgcctgcaggagtgctgggatgagagggatttccacagccaccaggaactcctaggagcccagccacagctggcaagatggaggcagttcctaaccctgggattcgtccctgcagccaaagctctgagctctccctgtccttggtctgcacatctgtagaatgggggggaaagcaggcagagagcaattcctgaggtctctctccacagttgtaatgtcattcaaacatgaccaaaggacagccatggagaaagagaacaaaattgttctttacctacccttgagggacagtgcaagaggagccagcaccccaggcctctctgtacatgccccctggatgcctcttcttaccctctgagctggagaggggaagccatatatgccctggcacccactctatgtttcttccagattctgagtcctctgagctatgacatgaaggagcccagagacagttaaggaggacagagctcactgactatgaccgaggttagatctccttcccatgtcctgagcctcggtttcctcagccttaatgacctgggagccacacctctcacatcacagaggctcccccagggagcctcttactcatgctttctagtgaactctagcctctgtcttggcacaaaagggcagtgctgtacatgttgcttcaataaataaaaggagtctgtcgtaaaaaaaaaaaaaaaaaaaaaaaaaaaa

SEQ ID NO: 30 - DNA, 1056 bp, Gallus gallus
atggagcgtgcctataaaatctgtgatgacaccacgtccaaaagactgaaaaacctcttctgggctgtgcagaacgggtccccccaggtgagccgttcctctcccaccaccctcaccgctcaccgcctggcttttctcccagcacagtgctgcaccgctgccttcatcggcctcctcttcacccgcttctggctgctcagtgtcctctatgccgcctggtggttcgtggacagggaagcaccgctcaggggtgggcgacggatccacatggtgcggaacagcgcagtctggagacacatgagggacttcttccccgtcacgctggtgaaaacagcagagttggaccccaggcagaactacttggtgggatttcacccccacggggtcctggcagtgggagccttcatcaattttggaacagaggcgacaggcttttccacgatcttcccaggcatcaccccacacctgatgatgctctccttatggtttcgtgtccccttcttaagggactacctgatgagcggaggccttgtgtcctctgataaggagagtgcgtaccatgtgctgcagaggccagagggggggaacctgttggccatcatcgttggtggggctcaggaggctctggatgcccggccaggatcctgcaccttgctgctgaagaataggaagggatttgtccgcgtggccatcgagcagggcaccccactggtccctgccttttcctttggggagaatgagctcttcgaccaggtgagcaaccccaagggctcgtggctgcggtggatccagcaccggctccagcagatcatgggcatctccctacccctcttccacgcaagaggtatcttccagtacagcttcgggctggtgccctaccgccggcctatcaacaccgtgattgggaagccaattcccgtgctgaagaagcacaagccaacggaggaagaggttgatcgagtccataagaaatacttagaagagctgagcaagctctttgaggagcacaaagctaaatacaacgtcccagaagacagtcacctcgaatttatatag

SEQ ID NO: 31 - DNA, 1287 bp, Danio rerio
gtgtttggttcagaatgacccagtaaacttgttcatttgtggagcctgtgggaataagtaaacaaatcatacctggatctttgagttctccagagctggattttactcgccctgctgtattgtcctgttcttcatcctgctcttcacccgtttctggctcatcagtgtgctttatgccacctggtggtacatcgactgggacacaccttcacgaggagggagaatagtgccatatctctgcaaactgcgtgtgtgggagtacatgagagattatttccccatcaggctgataaagacggctgacttggacactaggaagaactatgtgatgggttttcatcctcatggtattctcgtggctggtgcttttacaaatttctgcacggaggcgactggatttagcaaactcttccctgggataaagagcaaccttcttatgctgcctctctggttcagagcccccttcttcagagattacatcatgtcagcagggctggttccatcagacaaggagagtgccagttatctgctccggaggaagggcggagggaatgcggtggtcattgcagtcggtggagctcctgaagctttggatgcacatcctggtgactacaccgttcacctggccaataagaaaggctttattaagcttgcaatagagcacggtgcagatttggttcctatatattcgtttggagagaacgaggtgtttgaccaggtgcagaatcctcgtggcacatggctgcgatacattcaagagcgtctgcagcgcatcatgggtgtttctcttcctctctttcatgcgcgaggagttttccagtacaccttcggcctgatgccttacagaaagcccatcaacactgttgtgggaaggccaattccagtggagaaaaatgagaaaccaacagcagaagaattggacgtctatcatcagcgctatatggatgaactggcacggctgttcgaggaccacaagggaaattatggagtacctgaagacactcatctggtgttccagtgagatgatcacttatgttgacgatgagtttgtgtgtttgtaccttgtatttcttacattgtaggaaccaaatgtcttcacatatatagacataccactacatttgaccttgtggggacatttgtttggttctaatgttcaaaatggctcatgaatcatgctgaatttaatatttagaaaatgtaaaaatgccgattgttttctgtgagggttgggtttaggggtagaaaaaaaaccaaaaaaaaaaaaaaaaaaaaaaaaaaaaaaaa

SEQ ID NO: 32 - DNA, 1268 bp, Drosophila melanogaster
ccgagagccgataaggataagtataagtctagtacagggcaatttgaccatcgctggcttccatatcattcagtcgtgggagaaccgccgaaagagcagctggtggagtttttttgggcatttttgtaacacagcagacatgaaaatcgagtgggcaccactgcgggttcctctggaacgccgactgcagatactggtcacggcctttttcacctccatgctgctgatactattgtcagtttccttccttttggtagctggatcactgatctacggaggtcttttggtgcgtagtctgatggtaacttacttggcctacgtctttgtgcaccacaagaaaacccaatccgttgtggatggcaatggctggatgataacacgcaccaaccttttgcatcgccactatcgtgattactttcccgtggagctggtgaaaacagccgaactgccagctactaagaactacatcttggccagctttccccacggaattctgggcacaggcattggcattaacatgggcttggaaatctccaagtggctggagctattcccccaagtgcgtcccaaactgggcactctggatcagcatttccatgttccgttcatgcgtgaggtcctccgctgctggggtctggtgtcagtgtccaaagaggcgctgatccgtatgctcagcaagtcaaatgatcccaagcacaaggataatcgggatggtttcacctccaatgcggtggccattctggttggcggtgcccaggaagccatggactctcatcctgggcagtacattttaaccttgaagaataggaaaggcttcgtgcgaatggccattagaacgggctcatcgattgttccttcattttcctttggagaggtggacattttcgatcaggtggcaaatccccccaactcgctgctccgacggtttcaggactttgtcaagaagctcaccggagtctctccgctgattcctgtgggccgcggattcttcaactacacctttggcttcctcccattccgacgacgcattgtccaagttgttggtgctcccatcgatgttgttaagaacgagcacccagactcggagtatgtggataaagtgcatggacaggtcattgagtcgctggagaagttattcgatcagtacaaagacaagtacttggagaattcgaagagtgccactctagttgtacactagttttaaatcatgttgatacaaaatattcctatgtattgaaatagaaacgagctttttaattgaatttaaa

SEQ ID NO: 33 - DNA, 1269 bp, Drosophila melanogaster
agttaaatgttgtacgctcgcatcgtcggttctgctgctcaaacgcgataacgatccattactcgccggaggaccgtgctaccaagtagttcaactttccgagttcgagagctctgacatcatgaaaatcgagtgggctcccaaaggagttcccatggaacggcgtcgccagacgtttgccatggccttcctaatcctatcctttatgatactctcctttggatcctatttcttcgttgctgccgtgctgttctatggaagccttttgtggcgcaccattatggtcatctatttggtctacgtctacgcgaatcacaagagaacccactccattatggatggcaatggctggaaaattaaccgcaacaattggctgtttcggcattatcgggactactttcccgtacagctggtcaagaccgcagagctgccgccgaataagaactacattttggccagttttccgcacggaattttggggactggcatttccattaatatgggtctagacatctccaagtggctgcaactgttcccacaggtgaggcccaaggtggccactttggatcaaaacttcctgacgcccatcgtgcgtggtctcctgagatcttggggcctggtgtcggtttccaaggaggccttagtatatctgctaaccaaatcaaacgatcccaagcacaaggacaatcgtgatgggttcacctccaacgcggtggctattctggtgggtggtgcccaggaggcactagactcgcaccctggcaaatatatattgacactgaagaaccgcaagggattcgttaaaatggccattaggacagggtcttcgattgttcccacgttttcctttggcgaggtggacattctggatcaggttgccaatccaccgaactctcgggttcgtcgctttcaagactttgtaaagaggataacggggatatctccgctgattcccgttggccggggcatcttcaactactcctttggctttctgcccaaccgtcgacgcattgtccaagttgttggcgctcccatcgacgtggttcagagcgatcaaccagacgcagcctatgtggataagatacacaaacaggttattgacgacctggagaagatgttcgccaagtacaaggatcagtacataccgaactccaagcaggacaagctgattatacactagtcgagaagttattgtctaaacaatgtgatcaaatgagtgctttataagcatttaatataaaaattacgaattttatcaggcaaataaaa

SEQ ID NO: 34 - DNA, 1139 bp, Drosophila melanogaster
atgacaatcgaatgggctcctctccgggttccgctggaacggcggcttcagaccctggttacgtcattcttcacctataccttctttacgctgcccatctcgtcctgcctcgcagtagctatcctgctgtactacggcgaaatgtttgtgcgtagtctgcttcttatctattttgtgaaaatttatttggattataaaagaaattacggcattatggaaggtaatggttggttattctaccgcagcaattggagatatcgaaactacttccccgtcgaacttgtaaaaaccgccgagctgcctcccaacaggaactatatcgtagcaagctttccacacggaatacttggtactggaacttgcattaacatgagcctggacatcgacaattggctatccctttacccgcacgttcgacccaagatcgccaccctggatcatcacttcaagacgcctttcctgcgtgacatattgcgctggtggggcatggtatcggtttccaaggaatccctgtcctatttactcagcaagtcaaatgatccaatgcacaaggataatcgggatggtttcacatccaatgcggtggccgtacttgttggtggcgccaaggaagccatggattcgcatccgggacagtacattttgaccctcaaggatagaaagggtttcgtcaaaatggctgttcgaaccggatcgtcgattgtgccctcgttgtcctttggcgaggtggacatatttgatcaggtggctaatcctccggactcctcgctccgtcgcttccagaatgtggtcaagaaattcacaggcatttcaccgctccttcccaagggtcgcggtatcttcaactacaactatggcattctcccacatcgacgacgtattgtccaagttgttggttcccccatcgatgtggaaagatgcgagactcccgatcccgaatatgtggacaagatccatgggcaggtgatcgacgcgctggcgaggatgttcgatgaatacaaagagaagtacactccaaactcaaagcatatcaaacttataatacagtgactcagtagagtcccttagattgtgattttttatagaattaaggaaacttttgaaacgcaacacagttttagactaatttaaaaaaaaaa

SEQ ID NO: 35 - DNA, 1971 bp, Anopheles gambiae
cgcatgaggagaaaagttggccactcagttattatacgcgacaagctcccagtataagcgtcattgttagatcgcattctacaatgacaaacggacccgacatcattagtcatgtttggccggtggtcagaagaaagcacagagggtggaagaaaagctgattcattgggtgaggacgttagtctgcgggcgtgtttttatcgtctcagtttgcatcatgccccagtgaaagtgataccgacacgacatttggtgaagccattcggttcaagattaagggacaggctaaaccagtacaagtgagtattcgttgattcattcgtaaaccgaacgttgtttgctcagcaagaagcaatgactgataagtgataacgtaattgcatcatcggcatcaatgctgataagatctcgagctgcgggaaggaaaacgcatcaagtggtacatcgtttgtggtgtgatagattttgggagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 36 - DNA, 1612 bp, Anopheles gambiae
gtcacattctaaccttacgcccgtgctgaaccccaggggagaccagtgcgcgctccactgtgaactccctagtgtgtagtgtattcttttcctgttgttttagatgtattaagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggtgccaacaggtgatattgttatacagctctgcgagagggagtcaattactagctgcgtaagagaggacacactacattgggagtgtttagcatttaaattctcgtgtaagtgtaattgtgtaa

SEQ ID NO: 37 - DNA, 1017 bp, Tribolium castaneum
atgaagattttggggatcaagttcgcccctttgcacatccccctcgagcgccgcttgcaaacccttgccgccggatgctggttcacaaccctggcctttggtaccttcatcggtaccttcatctgggtgtacgtcttcttcacccgattctggtacctgtccgtcctttacgccaccataatatacctcgagaaaagcaagtgtgagaagggcggccgccccatcgaatggatcagacattggggatggtggtactacttgaaaaactacttcccctgtaagcttgactttgtcccgggcctaacctttgatccgaagaggaattatctatttgcctgttacccccatgggatcctcccggcgggccctttcaacaccattggtagcccttacagcgaatttagcaagttgtttccaaagtttcgggtgaggttggtgattctgcaccaacatttcttcattccgtttctgcgggagattgcttatgggacaggggggatttcggcctcggccaagtcgttgaatcatgttttggggagtccggaaggggggtatattgcggtgttgatgcccgggggcgcagttgaggcctataacagccggcctggacagtacagaatcatcctgaagaacaggaaaggcttcgtaaaactggccttgaggaatgggtcaccactagtaccagttatctcgttcggggagccggaattgtttgatcaagttgaagggaggactttgaggaagattcaggagtccatcaggaagtacctcgggctggcacctgtgattttctcagggagagggttcttccagtactcgtttggcgttattccacaaaggaggcctattacgaccgttgtcgggcacccgattgaagttaccaaaatcgaaaaaccaacaaacgaggaagtggacgaactacataaaaagtacatgcaagagctggagaacttgttcgaagagtacaaattcaaatatttggagaatccgaaggacatacacttggagtttgaataa

SEQ ID NO: 38 - DNA, 1420 bp, Homo sapiens
cactcacacacctacggacacacgctactctgggaggtgatttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactccatgcctccaataaaaggtagttctgggcccagcgcagtgcctcgtgcctgtgatcccagcactttgggaggccagggtgggaggatcgtttgagcccaggagttgaagaccagcctgggcaacacagtgagacttcatttctacaaaaaaaaaaaaaaa

SEQ ID NO: 39 - DNA, 1934 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 40 - DNA, 2223 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtgggtgagtgcccacctccggggggacggccaccagcagctgcgtgggcatcagggatccctcgcccacctgtctccctctccctgcagtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 41 - DNA, 2137 bp, Pan troglodytes
ccactcacacacctacggacacacgctactctgggaggtgatttgcgacttagccaggcccccaaagctgggctcctgtagggagaaagtctgcccaggtccacatccaagccttcatcgtttgtcctctgggttctgggatcttgctggaagaggggagcttctgcaatgggagttgccacaaccctgctgcccccaaccacttccaaaaccctgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaactgggcaatttggagacaactaagggattattatcctgtcaagctggtgaaaacggcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtcccgtgagccgccagagcctggacttcatcctgtcccagccccagctcgggcaggccgtggtcatcatggttgggggtgcgcatgaggccctgtattcagtccccggggagcactgcctaacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagttcatgggcttctctccttgcatcttctggggtcgtggtctcttctcagccacctcctggggcctgctgccctttgctgtgcccatcaccactgtggtgggccgccccatccctgtcccccagcgcctccaccccaccgaggaggaagtcaatcactatcacgccctctacatgatggccctgcagcagctcttcgaggagcacaaggaaagctgtggggtccccgcttccacctgcctcaccttcatctaggcttggccgcggcctttcgctgagcccctgagcccaaggcactgagacctccacccactgtggactccatgcctccaataaaaggtagttctgggcccagcgcagtgcctcacgcctgtaatcccagcactttgggaggccaaggtgggaggatcgtttgagcccaggagttgaagaccagcctgggcaacatagtgagacttcatttctacaaaaattaaaaaataatgttgttaattagccgggcatggtggcatgtgcctgtaatcccagctatttgggaggctgaggcaggagacttgcttgaacccaggaggcggaggttgcagtgagctgagatcacaccacagtactccggcctgggcaacacagcgagactcaatctcaaaaaaaaaaaaaaaaaaaaaaaaagatggttaaagctatagtaggctgggcgtggtggctcatgcccataatcccaacactttgggaagccaaggcaggtggatcacctgaggtcaggagttcaagaccagcctggccaaaatggcaaaaccccctctctactaaaactacaaaaattagccgggcatggtggctcatgcctataatcccaggtactccggaggctgaggcaggagaatcgcttgaacccaggaggcagaggttgcagtgagccgagatcacaccactgcactccagtctgggcaacagagcgagattccatctcaaaaaaaaaaaaaaaatgttgttaaagctataatcattctggaagtgaacatggccaggcatgacctgcccccatcctgatgtgctacaaagctgctgccttagattgggtatcaggaccctgaactgtcctcccagtgagagttcagtctgtggcatgaccttggacaagcctcttccttttgcctgtttacttctttgtctgtaaataaaggcatctgcttagcaaaga

SEQ ID NO: 42 - DNA, 1749 bp, Canis familiaris
atgacgttccctgaccccaagacgggacagtgctgcctctctccggtcctgtccgggcctgggggcggccgggtggccctgctggccctgggagggcccctggaagcgctggaagcaaaacccggcgcgctgttttgcggatccggaatcagaagagatttgtccagctggcaccgggacacggagcgagctcttccagccgttcgcgaaccctccggacccttgggcctccttctgcccttccgggcgcgcccatccacccggtccgggagtcccagcctctgccccctcggctcccctgcgcgcaccagctccgcagcgctcgggccagcgcgctccccgcgccggggcgggaaccccgcgctgctgcccacgcctgggcacaccggctcacctcttttgacactcccagtccctgactctgtcgagacggtcgcgcgtggcaatgaagaggccgggcggtgccggggatcccgttctgcgcgcatggcgcggctcacgcggctgttccgggagcgcaaggcgcgcgccggcctcccgggccacccgcacctccccgccgtgtccctgaggtgccgacactcccggggacctgcacacggagccggggcgcgcaccaggggcctgcccggccacgctgggccccggaggcgtggagcgtttggtcgctccagcaagaaagccttcactccgtgcccaaaccttcgtcgtttgcgctccaggccctggaaccccactggcggaggggagcgccccaccatgagaaccacgcagaaacagtggctagaagccttaagcgtctcctattacgtgttcactttcctcttcatgggccttttcttctcccttcttgtcctcttcctcctcttcacttcattctggtccatctctgttctctacttggtgtggctcttcctggactgggacacacccaaccaaggtgggaggtgctttgagtgcaacaggagctgtaccatttggaaacacttgaaggattattttcctattaagctggtgaagacagcagagcttccccctgaccggaactatgttgtgggttgtcacccacatgggatcatgtgcatgggaaccttctgcaatttcttcacggaggccaacaacttctccaagcagttcccggggattcagacatcacccgtaacactggcctttctcttgcacctcccagtctatcgtgactacctcatgtaccttggactgtgttctgtgaaccgccggagcctggactttattttgtccaagccccagcccgggcaggcggtagccatcgtagttgggggtgcccacgagtccctgtttgcgatcccagggatgcactgcctcgttctccggaaccgcaaaggcttcgtgcgcctggcactgaggcacggagcttccctggtacctgtgtactcctttggggagaatgatatcttcaattttaaggcttttcccacaaactcctggcagtatctgtgccagatcaccatcaagaagatcatgaaattttctccttgcatcttctggggccgcggactcttctcagctgactcctggggtttactgcccttcgccaagcctatcaccactgtggtgggccgccccatccctgtgccacagcgcctcaaccccactgaggaggaagttgaccactatcacatgctctacatggaggctctagagcaactgtttgaggaacacaaggaaagctgtggtgtcccagcctctactcacctcatctttaaatag

SEQ ID NO: 43 - DNA, 1221 bp, Bos taurus
atgataagtgagagcagactggagacctctggggctctgatgagagagtctccccacgcacacagccccctacaagcgatcctgggaggctcccaagcgcttggccactcagaccagaaagatttcctgcgctccaaccaaagccttcatcccatttttcctggttcggaagccctgctggctgaaggggagcacctgggagtctccaccaccccaccacccacccccagcatgaaaaccttaaagaaacagtggttagaagtactgagcacctaccaatatgtgctctgtttcctcttcctgggccctttcttttcccttgttggcttcttcctcctcttcacctcgctctggtatctctctgttctctacttggtatggttattcctggactgggacacaccccagcaaggtggaaggcgtaatcagtggttgaagaactgcactgtgtggaaacacctgagcgattatttccccattaagctggtgaaaacagtagagctgcccccagacaggaactacgtgctattgtcccacccacatgggatcatgggctttggaaccgtctgtaacttcagcacggagggcactggctgctcgcagctgttcccagggcttcggttctcactggccgtgttgaattgtctcttgtacgtgccaggctgtcgagagtacattatgtcctgtggaacatgttctgtgaaccgtcagagcctggattatgttctatctcaaccacagctcggcagggctgtggtcatcatggtcggaggggccaatgaggccctgcataccgtcccaggggagcactgcctcactctccggaatcgtaaaggcttcgtccgcctggcactgaggcacggtgcctccctggtgcccgtgtactcctttggggagaatgacgtcttcagagttaaggcttttgccccagactcctggcagcgtctgttccaggtcaccatcaagaggctcctgagcttctctccttgcatcttctggggccgtggtctcttctcagccaagtcctggggcctgatgcccctcgccagacccatcaccactgtggtgggccgccccatcccggtgccccagtgtccacagcccaccgaggagcaggtggaccactatcacaggctctacatgaaggctctggagcaactgtttgaggagcacaagaagagctgcggcctcccggcttctactcacctcaccttcatctag

SEQ ID NO: 44 - DNA, 1872 bp, Danio rerio
acacacagtcgctccaccctcatacagacgtcgcacgagcgaggagcatacattcactcaaactcaagggatatttaaaagatatttcccgacttaatgacattttctagctcaagcaggtattcgcggcgtcttctagtcacccagtcgtgacagcaaagactcgaattctttctctgtttacaaatgattcacgttaaagcaaagcgtcgtttacagggggttcagtcatgcggacgcggattcaaaagtggctggagataaacctcagatagccagtccagaaactacccacatacatttgcaatgacgcgataagacaacgaatcgttatctgtttgaccaattgaaccgatcaaagtgcgagccagacaaatacaagacttcggtcagtgaaggtgaggaagaggattcgtttgccacaggatcactaaacttggccactttaatgggaacagataacgtttcagaggtaaaggagaagggggacaggtcaccatggaaagatataatcgaggatataagtgttttgcaattggtgttgtcatttctttttttaggagtggcttgtctactattgatgatctacctgatgttcacctctctgtggattttccccactctgtacttcacctggcagatctatgattggcacacacctgagagaggtggcagaagaacaaagtttgtgagaggctgggaagtatggaaacacttgcgagactattttcctgtgaagctggtaaagactgctgaattaaatcccaataagaactatattatgggctgtcacccgcacggcatcatgtgttttggagccttctcctgcttcagcacagaccgcaatggatttgcggaaacctttcctggaatacggtccactcttgcaatcttagccggacttttccgccttcctctcttcagggaatacattttagctgcaggattgctgcctgtcagtaaggcaagtttggattatttgctgagccaaactggtgtgggtaacgctgtggtcatcatcattggtggagcagaggaatcactgacctcctctacaggagtaaacactgtggtcataaaacacaggaaaggctttgtacgactggctcttgaacacggggcagacctggttccagtgtactcttttggagagaacgagctgttcccgcaggtggttctgtctgagggcagtgtaggtcgacggctgcaggttctttttaagcagattatgggttttgctccatgcatcttcacaggaggccggtggcttcttctgccgtacaaacttccagtcaccactgtggtgggctgccccataaacgtccctctggtgaaaattccaactcaggaacaggtggatcattaccacggtttatacatggcatctctggctgatcttttccacaagcataagaccagctatggactggcagagacgcacgagctgcacttcatttagcagtgctggaaagcacaaagccatttaaaaagctgactgggatataatgtggggctgatataggaaaaggacaatgcacttatttctgtactgttccatgtgaatgttttaacttcttggttctctgaaatgattcacaaagcacaaaatgaaccaaatgaatacggagatgggcatttgtctgtaacaaaacactcatccttaagaaaggcaaaaggtttgcttacggttatctcagctttgttctgtaaatttgcactgaaatttttacaacatgttagtgtttattataaaggttatacaaagacttttgaagaaaatcatttttaaaaattggtttaatataaatgatttacatatgtattttgttatgtctattcatgtgaaagattataaaaccagcacatttttac

SEQ ID NO: 45 - protein, 334 aa, Homo sapiens
MKVEFAPLNIQLARRLQTVAVLQWVLSFLTGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 46 - protein, 335 aa, Mus musculus
MMVEFAPLNTPLARCLQTAAVLQWVLSFLLLVQVCIGIMVMLVLYNYWFLYIPYLVWFYYDWRTPEQGGRRWNWVQSWPVWKYFKEYFPICLVKTQDLDPGHNYIFGFHPHGIFVPGAFGNFCTKYSDFKKLFPGFTSYLHVAKIWFCFPLFREYLMSNGPVSVSKESLSHVLSKDGGGNVSIIVLGGAKEALEAHPGTFTLCIRQRKGFVKMALTHGASLVPVFSFGENDLYKQINNPKGSWLRTIQDAMYDSMGVALPLIYARGIFQHYFGIMPYRKLIYTVVGRPIPVQQILNPTSEQIEELHQTYLEELKKLFNEHKGKYGIPEHETLVFK

SEQ ID NO: 47 - protein, 334 aa, Pan troglodytes
MKVEFAPLNIQPARRLQTVAVLQWVLSFLTGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 48 - protein, 335 aa, Pan troglodytes
MKVEFAPLNIQPARRLQTVAVLQWVLKYLLLGPMSIGITVMLIIHSYSFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVLSVGLVSVSKKSVSYMVSKEGGGNISVIVLGGAKESLDAHPGKFTLFIHQRKGFVKTALTHGASLVPVVSFGENELFKQTDNPEGSWIRTVQNKLQKIMGFALPLFHARGVFQYNFGLMPYRKAIHTVVGRPIPVRQTLNPTQEQIEELHQTYMEELRKLFEEHKGKYGIPEHETLVLK

SEQ ID NO: 49 - protein, 335 aa, Canis familiaris
MKVEFAPLHIPLARRLQTAAVLQWVLSFLLLAQVCIGIIVVLIVHNYWFLYVPYLTWLCLDWRTPEQGGRRSNWVRSWTVWRYFKDYFPIHLIKTWDLDPSHNYIFGFHPHGVLVAGAFGNFCTNHSDFEELFPGFTAYLHVLPFWFRCPLFREYLMTSGSVSVSKKSVSYVLSKEGGGNISVIVLGGAEESLDAHPGKFTLFIRQRKGFVKVALTHGASLVPVFSFGENELFKQVNNPEGSWLRTVQEKLQKIMGFALPLFHARGIFQYNFGLMPYRKPIHTVVGRPIPVHRTPHPSPGQIEELHQTYMEELRKLFEAHKRKYGIPEHETLIFK

SEQ ID NO: 50 - protein, 335 aa, Bos taurus
MKVEFAPLNIPLARRLQTAAVLHWLLSFLLFAQVCLGIIVFLIIYNYWFLYLPYLTWLYFDWQTPEQGGRRSEWVRNWAIWRYFKDYFPIHLIKTWDLDPSHNYIFGFHPHGVLVVGAFGNFCTNYSAFKELFPGFTSYLHVLPYWFRCPLFREYLMSSGPVSVSKKSVCHVLSKEGGGNISVIVLGGAEESLDAHPGKFTLFIRQRKGFVKIALTHGAYLVPVFSFGENELFKQVSNPEGSWLRNVQEKLQKIMGFALPLFHARGIFQYNFGLIPYRKPIHTVVGRPIPVRQTLNPTSEQIEELHQTYMEELRKLFEEHKGKYGIPENETLIFR

SEQ ID NO: 51 - protein, 183 aa, Rattus norvegicus
MSKEGGGNISVIVIGGAKELLESFPGRYSLCLLQRKGFVKIALTHGAHLVPVFSFGENELYSQVDNPKGSWLRTAQDKVYNLTGLALPLFYARGIFQNSFGLMPYRKLIYTVAAVGTAARLTQKSNHQNDSSVSAEKGNSFICCQVGWCDRDRQPLAAPSLFRRLCTRPQSRLMSCIRRTWRS

SEQ ID NO: 52 - protein, 287 aa, Danio rerio
MLGALYAGWLYLDRDTPSCGGRRSQWVRSWRIWMHFRDYFPITLVKTVDLDPRHNYLLGFHPHGVLVAGGFGNFCTEASGFSQMFPGLTPYLLMLPFWFRVPFFREYIMCGGLVSSEKASASYLLGHPGGGQAAVIAVGGAPESLEARPGALTLQLLQRKGFIKLALKHGAWLVPVFSFGENELFDQMENPAGSALRRMQERLQRIMGVALPLFHARGVFQYSFGLLPYRKPIHTVVGRPIPVSQTPCPSKEDIDALHTLYMQGLTQVFEENKKHYGIADDKHLKFT

SEQ ID NO: 53 - protein, 349 aa, Caenorhabditis elegans
MLDRTESEDKMPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 54 - protein, 339 aa, Caenorhabditis elegans
MPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 55 - protein, 340 aa, Caenorhabditis elegans
MPQFLGIEWVDLFSSIQRKKTYLGVVYHFMLTYPLALFVTILPFFLLFTFQWHILALYACWYFYDMDSPRRGGYSSDWVRKWRVNDWFAQYFPINLHKTAELSTDKNYLVGIHPHGIISMAAWSNFATNGTGIYEKFPGIRWNLCTLALQFRMAIRRELLLLTGLIDCSRESIEYVLDKCGQKGRAVVLVIGGAEEALDAHPGYHTLTLASRKGFVREALITGAYLVPVYSFGENDVFEQMENPVGSRLRNFQEWCKSIFGISYPIFHGRGFFQLTFGYLPFRKPIDTVVGAPIPVEKVENPTKEQIDELHTIYCQKLTELFDEHKEKYGVEKDVPLVLR

SEQ ID NO: 56 - protein, 345 aa, Caenorhabditis elegans
MLNYQIHKKLTDIKWVNIFSPWDRQRAYFALVVWFGLIYPFCCLCQVAPFVLFFTGQWIILGLYAVWYLYDRESPRRGGYRDNWFRNLSLHKWFAEYFPVKLHKTAELDPNQNYLFGYHPHGILGVGAWSCFGFDACNVKQVFKGIRFNICTLPGNFTAMFRREILLSIGMIESSKESIEHVLNSEEKGRAVVIVVGGAAEALEAHPGKHTLTLANRKGFVREAVKTGAHLVPVYAFGENDIYKQIDNPEGSKLRKIQEWGKKKMGISLPLIYGRGYFQMALGLLPMSRAVNVVVGAPIQVEKELDPSKEVIDEIHGVYMEKLAELFEEHKAKFGVSKDTRLVFQ

SEQ ID NO: 57 - protein, 359 aa, Caenorhabditis elegans
MRLRLSSISGKAKLPDKEICSSVSRILAPLLVPWKRRLETLAVMGFIFMWVILPIMDLWVPFHVLFNTRWWFLVPLYAVWFYYDFDTPKKASRRWNWARRHVAWKYFASYFPLRLIKTADLPADRNYIIGSHPHGMFSVGGFTAMSTNATGFEDKFPGIKSHIMTLNGQFYFPFRREFGIMLGGIEVSKESLEYTLTKCGKGRACAIVIGGASEALEAHPNKNTLTLINRRGFCKYALKFGADLVPMYNFGENDLYEQYENPKGSRLREVQEKIKDMFGLCPPLLRGRSLFNQYLIGLLPFRKPVTTVMGRPIRVTQTDEPTVEQIDELHAKYCDALYNLFEEYKHLHSIPPDTHLIFQ

SEQ ID NO: 58 - protein, 412 aa, Kluyveromyces lactis
MGKEQIRKRQTKKVRKGSQPVANGKSSVVGVSKDGKPEFCAIDTPIERRLQTLSVAWYVECIPLMIIIMLFVWVNPLMWSFVIPYTIYYFIDRTASNGNAVKRHSKWFRSLKVWFYFRDYFPISMHKSTELEPTFTSIDSTELENDASEPGYLDSSQPVLPDKWWNPFREKDETVRPTGPRYIFGYHPHGIAAFGAFGAFATEACNWSKVFPGIPVCLLTLVNQFQIPVYRDYLLALGITSVARKNAMKVLEKNYSIAIVIGGASESLLTNLGSSDIILSKRKGFVKLALQTGNVSLVPVYGFGETDTYKILKLKNDSIIGRIQIWLKENYSFTVPLFFARGVFNYDFGLLPFRHPVNVVVGNPIHIKEKIDHPTIEEIDHYHSLYIEELKRLYDDNKAKFNYSEKTLNIVE

SEQ ID NO: 59 - protein, 461 aa, Ashbya gossypii
MQDSMDDSLREAEGRQDDSEVSSGTTLGSSTPEDSGVTAKLRKKYQMASALLRRELEELSVYDAKTAGVSGRSSGSGSGGLALLGGRFHVAPLRIPARRRLQTLVVAWHTSSFIYMTVLVLFLAANPLMWWFMVPYMVYYVWNRSPANGGVVRRYSPRLRSLALWRYYCEYYPISLHKSEDLAPTFVPDPRGAEPREWKLRLWLWPTRVELLNLTLQWTRARPQVATGPRYIFGYHPHGVGALGAFGAIATEGCNWSKVFAGIPACLCTLVNQFQIPIYRDYLLGLGCTSVARKNVLKVLEQNYSVCIVVGGAQEALLSRVGSTELVLNKRKGFIKLALETGNVNLVPIYAFGETDCFNVLDTGNESYLRKFQLWIKKTYGFTIPFFFARGVFNYDFGFLPFRNPINVVVGKPVYVDKRRTNPTMEEIDHYHDLYVQELRNVFDKNKHKFGYAGKELKIVE

SEQ ID NO: 60 - protein, 550 aa, Magnaporthe oryzae
MATVDDTQNHVQLNAESSLNEFPYQASADKEEYPSLPSAPLPDVDGSSQNGHTAANADLPPSESTEQPWNKVASGDFIHETKMPSEDRDNLARPGSLPTPEPSRRGSNTLVGSPRQGDGLQMLMDEFADDESSDTSWDIHETIRSRTQALAEKDHQGIFSNQRRGNQADAPDTVTSANAWLPAGFEDDLDEVTGADDEFEPTRGSRWRVRLAPLDTPFHRRMQTLVVLLHVLGMGITFSFFCFLCTLPLFWPIIIAYLVFIRLSRAGSDGKTNRRIEWLRRARIWKYFADYFPVKLHKTADLPPTRKYIFAIHPHGIISHGAFASFATEALGFSEKFPGITNSVCTLHGNFKTPFYREYLMAMGLISVSKESIINTLMTGGINGEGMGRAVSIIVGGAREALEACPKTMRLILKRRGFCRMALRTGADLVPVLCFGENDLYQQWGPQDHPRFRRLQMKALAYLGFAVPVLRGRGVFNYDFGVLPQRRPINVVVGEPIKVEQFRGSGNIEPRVEELWKLYCQKLQELYDQNKHVYFKDRQEDMRFVDSEEL

SEQ ID NO: 61 - protein, 334 aa, Ciona intestinalis
MWEFAPLRIPMIRRLQTLAVSHFVFCFLALAATCTLLTIYITLFTSYWPITTAYLVFLFLDRNTPESGGRRSEWVRNWSLWKWMSDYFPCTLHKTVDLDPKRNYIFGIHPHGVLCIGSFTHFSTNGSGFSHVFPGFTSYLTMLPFWFKMPFFRDYVMSGGLTPATRKAIKHTITRPGGGHICCIIPGGAPESLNARPGDVVLLLKQRLGFLKLAITNGVPLVPVFSFGDHALWEQKPNPPGSLIRRFQDSSQKWMQVALPVFHARGIFQYNFGLIPYRRSVHTVVGEPIEVPQNSNPTSEDLMSLQEDYINRLRAIFDEHKSKYLPEDCKLIIN

SEQ ID NO: 62 - protein, 334 aa, Homo sapiens
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 63 - protein, 334 aa, Mus musculus
MVEFAPLLVPWERRLQTFAVLQWVFSFLALAQLCIVIFVGLLFTRFWLFSVLYATWWYLDWDKPRQGGRPIQFFRRLAIWKYMKDYFPVSLVKTAELDPSRNYIAGFHPHGVLAAGAFLNLCTESTGFTSLFPGIRSYLMMLTVWFRAPFFRDYIMSGGLVSSEKVSADHILSRKGGGNLLAIIVGGAQEALDARPGAYRLLLKNRKGFIRLALMHGAALVPIFSFGENNLFNQVENTPGTWLRWIQNRLQKIMGISLPLFHGRGVFQYSFGLMPFRQPITTIVGKPIEVQMTPQPSREEVDRLHQRYIKELCKLFEEHKLKFNVPEDQHLEFC

SEQ ID NO: 64 - protein, 334 aa, Pan troglodytes [sequence omitted]

SEQ ID NO: 65 - protein, 334 aa, Canis familiaris
MVKFAPLFVPWERRLQTFMVLQWVFSFLALAQICTVVFVGLLFTRFWVVSVLYAAWWYRDRDTPRQGGRPVQALRRCFLWKYMRDYFPVTLVKTAELDPSRNYLAGFHPHGVLAAGAFVNLCTESTGFPLLFPGIRSHLMMLTLWFRVPFFRDYIMSGGLVTSDKESAAHILSRKEGGNLLAIIVGGAQEALNARPGDSTLLLRNRKGFIRLALMHGAALVPIFSFGENELFDQVENSPGSWLRRIQNRLQKIMGISLPLFHGRGVFQYSFGFIPYRQPITTVVGKPIEVQKTLCPSKEEVDKLHQRYVKELCELFETHKLKYNVPVDQHLEFC

SEQ ID NO: 66 - protein, 332 aa, Bos taurus
MVEFAPLFVPLERRLQTFAVLYWIFCFMVLPPLCLVVFIGLLFTRFWLFNILYVIWLYLDQNRPRQGGSHNKFLKRWVLWKYMKDYFPITLVKTTELDPSRNYLAAFHPHGLLSVGAFTNMCTDSTGFSSLFPGIRPHLTTINIYFRIPLFRDYIMQGGLVSSDKESIAYILSRKGGGNLVAITVGGIREALKTRPGANKLVLRNRKGFIRLALMHGAVLVPIFSFGDNELYAKTSPGFWWKWFRDQLYKKTRLAIPFFYGRGVFQYSFGFMPYRRPITTVVGKPIEVPKIPHPSQEEVDRLHQHYLKELSNLFETHKLKYNIPKDQHLEFC

SEQ ID NO: 67 - protein, 334 aa, Rattus norvegicus
MVEFAPLLVPWERRLQTFAVLQWVFSFLALAQLCIFIFIGLLFTRFWLFSVLYATWWYLDWDRPRQGGRPIQFFRRMAIWKYMKDFFPVSLVKTAELDPSRNYIAGFHPHGVLAAGAFLNLCTESTGFTSLFPGIRSYLMMLTVWFRAPIFRDYIMSGGLVSSEKVSADHILSRKGGGNLLAIIVGGAQEALDARPGAYRLLLKNRKGFIRLALTHGAALVPIFSFGENNLFNQVENTPGTWLRWIQNWLQKIMGISLPLFHGRGVFQYSFGLVPFRQPITTVVGKPIEVQMIPHPSEEEVNRLHQLYIKELCKLFEEHKLKFNVPEDQHLEFC

SEQ ID NO: 68 - protein, 351 aa, Gallus gallus
MERAYKICDDTTSKRLKNLFWAVQNGSPQVSRSSPTTLTAHRLAFLPAQCCTAAFIGLLFTRFWLLSVLYAAWWFVDREAPLRGGRRIHMVRNSAVWRHMRDFFPVTLVKTAELDPRQNYLVGFHPHGVLAVGAFINFGTEATGFSTIFPGITPHLMMLSLWFRVPFLRDYLMSGGLVSSDKESAYHVLQRPEGGNLLAIIVGGAQEALDARPGSCTLLLKNRKGFVRVAIEQGTPLVPAFSFGENELFDQVSNPKGSWLRWIQHRLQQIMGISLPLFHARGIFQYSFGLVPYRRPINTVIGKPIPVLKKHKPTEEEVDRVHKKYLEELSKLFEEHKAKYNVPEDSHLEFI

SEQ ID NO: 69 - protein, 252 aa, Danio rerio
MRDYFPIRLIKTADLDTRKNYVMGFHPHGILVAGAFTNFCTEATGFSKLFPGIKSNLLMLPLWFRAPFFRDYIMSAGLVPSDKESASYLLRRKGGGNAVVIAVGGAPEALDAHPGDYTVHLANKKGFIKLAIEHGADLVPIYSFGENEVFDQVQNPRGTWLRYIQERLQRIMGVSLPLFHARGVFQYTFGLMPYRKPINTVVGRPIPVEKNEKPTAEELDVYHQRYMDELARLFEDHKGNYGVPEDTHLVFQ

SEQ ID NO: 70 - protein, 352 aa, Drosophila melanogaster
MKIEWAPLRVPLERRLQILVTAFFTSMLLILLSVSFLLVAGSLIYGGLLVRSLMVTYLAYVFVHHKKTQSVVDGNGWMITRTNLLHRHYRDYFPVELVKTAELPATKNYILASFPHGILGTGIGINMGLEISKWLELFPQVRPKLGTLDQHFHVPFMREVLRCWGLVSVSKEALIRMLSKSNDPKHKDNRDGFTSNAVAILVGGAQEAMDSHPGQYILTLKNRKGFVRMAIRTGSSIVPSFSFGEVDIFDQVANPPNSLLRRFQDFVKKLTGVSPLIPVGRGFFNYTFGFLPFRRRIVQVVGAPIDVVKNEHPDSEYVDKVHGQVIESLEKLFDQYKDKYLENSKSATLVVH

SEQ ID NO: 71 - protein, 352 aa, Drosophila melanogaster
MKIEWAPKGVPMERRRQTFAMAFLILSFMILSFGSYFFVAAVLFYGSLLWRTIMVIYLVYVYANHKRTHSIMDGNGWKINRNNWLFRHYRDYFPVQLVKTAELPPNKNYILASFPHGILGTGISINMGLDISKWLQLFPQVRPKVATLDQNFLTPIVRGLLRSWGLVSVSKEALVYLLTKSNDPKHKDNRDGFTSNAVAILVGGAQEALDSHPGKYILTLKNRKGFVKMAIRTGSSIVPTFSFGEVDILDQVANPPNSRVRRFQDFVKRITGISPLIPVGRGIFNYSFGFLPNRRRIVQVVGAPIDVVQSDQPDAAYVDKIHKQVIDDLEKMFAKYKDQYIPNSKQDKLIIH

SEQ ID NO: 72 - protein, 349 aa, Drosophila melanogaster
MTIEWAPLRVPLERRLQTLVTSFFTYTFFTLPISSCLAVAILLYYGEMFVRSLLLIYFVKIYLDYKRNYGIMEGNGWLFYRSNWRYRNYFPVELVKTAELPPNRNYIVASFPHGILGTGTCINMSLDIDNWLSLYPHVRPKIATLDHHFKTPFLRDILRWWGMVSVSKESLSYLLSKSNDPMHKDNRDGFTSNAVAVLVGGAKEAMDSHPGQYILTLKDRKGFVKMAVRTGSSIVPSLSFGEVDIFDQVANPPDSSLRRFQNVVKKFTGISPLLPKGRGIFNYNYGILPHRRRIVQVVGSPIDVERCETPDPEYVDKIHGQVIDALARMFDEYKEKYTPNSKHIKLIIQ

SEQ ID NO: 73 - protein, 353 aa, Ashbya gossypii
MGKIEWAPLNVPMRRRIETLSTALWMWLILFGELGMLISYFLLLIYGNLFIKSLCVIYGYFIYTDRKVTLNGGRGQGVTWWRELFWWKLYQSYFPAKLHKTVDLDPNRNYLFAAFPHGVLGLGAFINFATNATGFHDKFPKIRSRPVTLNFHFVIPFFRELLLSWGLVSANPNSILSLLKAPNKPDHPLNDDGYTANAVVIVVGGAAESLHCRPNNYTLVLRKRKGFCKLAIKAGTPLVPVMTFGEVDLFDQPPNPPGSRLRRFQEFVKNTTGIAPAAFVGRGFFQYSYGLIPRRKPLNTVVGAPVEVTQIDNPTQEQVDEVHERFCRALDNLFETNKSRFIADYKNVKLVME

SEQ ID NO: 74 - protein, 353 aa, Drosophila melanogaster; identical to SEQ ID NO: 73

SEQ ID NO: 75 - protein, 338 aa, Tribolium castaneum
MKILGIKFAPLHIPLERRLQTLAAGCWFTTLAFGTFIGTFIWVYVFFTRFWYLSVLYATIIYLEKSKCEKGGRPIEWIRHWGWWYYLKNYFPCKLDFVPGLTFDPKRNYLFACYPHGILPAGPFNTIGSPYSEFSKLFPKFRVRLVILHQHFFIPFLREIAYGTGGISASAKSLNHVLGSPEGGYIAVLMPGGAVEAYNSRPGQYRIILKNRKGFVKLALRNGSPLVPVISFGEPELFDQVEGRTLRKIQESIRKYLGLAPVIFSGRGFFQYSFGVIPQRRPITTVVGHPIEVTKIEKPTNEEVDELHKKYMQELENLFEEYKFKYLENPKDIHLEFE

SEQ ID NO: 76 - protein, 341 aa, Homo sapiens
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 77 - protein, 281 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGGPPHPCPPAPPPHRGGSQSLSRPLHDGPAAALRGAQGKLWGPRFHLPHLHLGLAAAFR

SEQ ID NO: 78 - protein, 344 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVGECPPPGGRPPAAAWASGIPRPPVSLSLQWAAPSLSPSASTPPRRKSITITPST

SEQ ID NO: 79 - protein, 341 aa, Pan troglodytes
MGVATTLLPPTTSKTLQKQHLEAVGAYQYVLTFLFMGPFFSLLVFVLLFTSLWPFSVFYLVWLYVDWDTPNQGGRRSEWIRNWAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKFMGFSPCIFWGRGLFSATSWGLLPFAVPITTVVGRPIPVPQRLHPTEEEVNHYHALYMMALQQLFEEHKESCGVPASTCLTFI

SEQ ID NO: 80 - protein, 582 aa, Canis familiaris
MTFPDPKTGQCCLSPVLSGPGGGRVALLALGGPLEALEAKPGALFCGSGIRRDLSSWHRDTERALPAVREPSGPLGLLLPFRARPSTRSGSPSLCPLGSPARTSSAALGPARSPRRGGNPALLPTPGHTGSPLLTLPVPDSVETVARGNEEAGRCRGSRSARMARLTRLFRERKARAGLPGHPHLPAVSLRCRHSRGPAHGAGARTRGLPGHAGPRRRGAFGRSSKKAFTPCPNLRRLRSRPWNPTGGGERPTMRTTQKQWLEALSVSYYVFTFLFMGLFFSLLVLFLLFTSFWSISVLYLVWLFLDWDTPNQGGRCFECNRSCTIWKHLKDYFPIKLVKTAELPPDRNYVVGCHPHGIMCMGTFCNFFTEANNFSKQFPGIQTSPVTLAFLLHLPVYRDYLMYLGLCSVNRRSLDFILSKPQPGQAVAIVVGGAHESLFAIPGMHCLVLRNRKGFVRLALRHGASLVPVYSFGENDIFNFKAFPTNSWQYLCQITIKKIMKFSPCIFWGRGLFSADSWGLLPFAKPITTVVGRPIPVPQRLNPTEEEVDHYHMLYMEALEQLFEEHKESCGVPASTHLIFK

SEQ ID NO: 81 - protein, 406 aa, Bos taurus
MISESRLETSGALMRESPHAHSPLQAILGGSQALGHSDQKDFLRSNQSLHPIFPGSEALLAEGEHLGVSTTPPPTPSMKTLKKQWLEVLSTYQYVLCFLFLGPFFSLVGFFLLFTSLWYLSVLYLVWLFLDWDTPQQGGRRNQWLKNCTVWKHLSDYFPIKLVKTVELPPDRNYVLLSHPHGIMGFGTVCNFSTEGTGCSQLFPGLRFSLAVLNCLLYVPGCREYIMSCGTCSVNRQSLDYVLSQPQLGRAVVIMVGGANEALHTVPGEHCLTLRNRKGFVRLALRHGASLVPVYSFGENDVFRVKAFAPDSWQRLFQVTIKRLLSFSPCIFWGRGLFSAKSWGLMPLARPITTVVGRPIPVPQCPQPTEEQVDHYHRLYMKALEQLFEEHKKSCGLPASTHLTFI

SEQ ID NO: 82 - protein, 336 aa, Danio rerio
MGTDNVSEVKEKGDRSPWKDIIEDISVLQLVLSFLFLGVACLLLMIYLMFTSLWIFPTLYFTWQIYDWHTPERGGRRTKFVRGWEVWKHLRDYFPVKLVKTAELNPNKNYIMGCHPHGIMCFGAFSCFSTDRNGFAETFPGIRSTLAILAGLFRLPLFREYILAAGLLPVSKASLDYLLSQTGVGNAVVIIIGGAEESLTSSTGVNTVVIKHRKGFVRLALEHGADLVPVYSFGENELFPQVVLSEGSVGRRLQVLFKQIMGFAPCIFTGGRWLLLPYKLPVTTVVGCPINVPLVKIPTQEQVDHYHGLYMASLADLFHKHKTSYGLAETHELHFI

SEQ ID NO: 83 - protein, 520 aa, Arabidopsis thaliana
MAILDSAGVTTVTENGGGEFVDLDRLRRRKSRSDSSNGLLLSGSDNNSPSDDVGAPADVRDRIDSVVNDDAQGTANLAGDNNGGGDNNGGGRGGGEGRGNADATFTYRPSVPAHRRARESPLSSDAIFKQSHAGLFNLCVVVLIAVNSRLIIENLMKYGWLIRTDFWFSSRSLRDWPLFMCCISLSIFPLAAFTVEKLVLQKYISEPVVIFLHIIITMTEVLYPVYVTLRCDSAFLSGVTLMLLTCIVWLKLVSYAHTSYDIRSLANAADKANPEVSYYVSLKSLAYFMVAPTLCYQPSYPRSACIRKGWVARQFAKLVIFTGFMGFIIEQYINPIVRNSKHPLKGDLLYAIERVLKLSVPNLYVWLCMFYCFFHLWLNILAELLCFGDREFYKDWWNAKSVGDYWRMWNMPVHKWMVRHIYFPCLRSKIPKTLAIIIAFLVSAVFHELCIAVPCRLFKLWAFLGIMFQVPLVFITNYLQERFGSTVGNMIFWFIFCIFGQPMCVLLYYHDLMNRKGSMS

SEQ ID NO: 84 - DNA, 1856 bp, Arabidopsis thaliana
aaggaccttccctctctttctttccaaatctctctttatctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcatgtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtaccatttccccttgccttaactatgaatgatttgtaaactcaccttgtattataagatatcatagagaaaaacacattctcgact

SEQ ID NO: 85 - DNA, 1845 bp, Arabidopsis thaliana
atatccattctcaccttccaaatctccccactctctctctctctctctctctctctctctctctctctctctctatctctctctatctctctctatcttctcttttctcctctctccaacttcttcactaatgggagctcaggagaaacggcgccgtttcgagcagatatcaaagtgcgatgttaaggaccggtccaaccataccgtggccgctgatctagacggaacactactaatctctcgtagcgccttcccttactatttcctcgtagccctcgaggcagggagcttgctccgagcgttgatcctacttgtgtccgtaccattcgtttatcttacgtacttgaccatctccgagactttagccatcaacgtatttgtcttcatcacgttcgcgggtctcaagatccgagacgttgagctagtggtccgttccgtcctcccgaggttctatgcggaggacgtgaggcccgatacctggcgtatcttcaacacgttcgggaaacggtacataataactgcgagccctcgaattatggtcgagccattcgtgaaaacattcctaggagttgataaagttcttggaacagagctagaggtctccaaatcgggtcgggcaaccgggttcaccagaaaaccaggtattctcgtcggtcagtacaaacgtgacgtcgttttgagagagtttggtggcctagcgtctgatttacctgatttggggctcggcgatagcaagacggaccacgacttcatgtccatctgcaaggaaggttacatggtgccacgtacgaaatgcgaaccattaccaagaaacaaactcttaagccccataatattccacgagggcagattagtccaacgcccaacgccgttagttgctctgttaactttcctctggcttcccgtcggtttcgtcctctctatcatccgcgtctacacgaatattccgttaccggaacgtatcgcccgttacaactacaagcttactggcatcaagctagtcgtcaacggccaccctcctccgccgccaaaacctggccagccaggccatcttttggtctgcaaccaccgcaccgttctcgatcctgtggtcacagctgtcgcactcggccggaaaatcagctgcgtcacttacagcatcagcaagttctctgagctaatctcaccaatcaaagccgttgcgttgactcgtcaacgtgagaaagacgcagcgaacatcaagcgtcttttggaggaaggcgatctcgtgatatgtcccgagggaaccacgtgccgtgagcctttccttctccggtttagtgctcttttcgctgagctcacggaccggatcgttcccgtggcgatcaacacaaagcagagcatgttcaatggtaccaccacacgtggatacaagcttcttgatccttactttgcgttcatgaacccgaggccgacgtatgagatcacgttcctcaaacagattccagctgagctgacgtgtaaaggaggcaaatctccgatagaggttgcgaattacatacagagggttttgggaggaaccttaggttttgagtgcaccaatttcacaagaaaggataagtacgcaatgcttgctggtactgacggtagggttccggtgaagaaggagaagacgtgattattgatcggaggatggagaaaacaaagaaataatacaaagattggaatctttttcatttggatggttaattatcaatacttaaggggcaaagaattgataagtttgtttttgttgttacctttatcttctctgcttcggtgaatgtttcttcaagttttacatttagtacaataacggtttaagaaaagaaagaaaaaagtatcggt

SEQ ID NO: 86 - DNA, 1216 bp, Arabidopsis thaliana
tcacttcttggtgttgttgatagactccaccttgccgtcattacctccaagcaaaagatatttatccttgcgagtaagttcggtgcattcgaagcccaaaaccgcgccgataactttctggacgtaattagccacctctataggagtcttgccaccaccgttgacagtcatttcttcaggcaaacgatccaagaaagtggcttcatagcttggtcttgggttcatgaagaagaagtaagggtcccaaaacttcacacccctaactgtggtcccgttgaacattccttgtttacagttcatcgctactggcacaatccggtcgcttagctctgcgaatagagcgctaaatctcagtagatactcttctctacacgtcgtgccttccggacatatcaccaagtcgcctgttatacaccaaaaacatatcattagctcaacaactccattgatttttaatttctcaactaaagattaatgtgaatgtaagtcaatattcaaaagaagtaaacaatattattttatgttcatttatataaatttggttagaagatgcgttaattaggtaccaaagtaaacatcaaagaccataccaaagtaatatttactatattgagatttgcatgggctactatatatgtattcatcgaaaaataaaaagaaagaaatagaaactcctattgaaccccctggacagtgaaacttgttataggtatgctctagtaatatatgatgagaagatgtgtaaagtacctttctcgagaagttttctcatgttggcagcatcggtggcacggtcacgggtgagggcaacagcaggaataggagaaagcataagggagagacgagagacactgtaagtgacgcaacagatcttacgtccaagagcaatagcaacgatgatgggatcaagcgcggtacggtggttaaggacatagaggttgccaagagttccaggggaaggaggtggaggacgatgaccacgaatggttaagtggatcccgagcatctcgtaagtgtaacggacaaatctttcaggtaaagggaggttgaagtagacgcgaatgatggagaggatgaaaccaaaaggaagccataggtatgtgataatggcgtttaacggagttggacgttgcgctaaacgcccatcatggaagactatgcggttctttaagcgttcttttggaatcgttgtggctgacttggtcgcatgaaccat

SEQ ID NO: 87 - DNA, 1736 bp, Arabidopsis thaliana
atctctctttctctgtttactaaatcgccagtattcgccgcaagaaagatgtctccggcgaagaagagccgaagttttcctccgataagcgagtgtaaaagcagagagtatgattcgatcgctgcggatctcgacgggactctgcttctgtcaagaagctctttcccttacttcatgctggtggccattgaagcaggtagtctcttccgtggattgatccttcttctttctcttcccatcgtcatcatcgcttatctcttcgtctccgaatctctcggaatccaaatccttatcttcatctccttcgccggtatcaagatcaagaacatcgaactcgtctctcgcgccgttcttacacggttttacgcggcggatgtgaggaaagatagttttgaggtgtttgataaatgtaagaagaggaaagtagtggtgactgcgaatccgatagtgatggttgagccattcgtcaaagactatttgggaggagataaagttttgggaacagagattgaagttaaccccaaaacgatgaaagctactggttttgtgaaaaagcctggtgttcttgttggtgatctcaagagattagccatcttgaaagagttcggcgatgactcaccggatcttggcctcggtgaccgcacctccgatcacgatttcaagtccatttgcaaggaaggttacatggtgcatgagaccaaatcagccacaacagtccctatagagagtctcaagaaccgcataatcttccatgatggccgtcttgtccaacgtccgaccccattaaacgccttaatcatttacctttggcttcctttcggcttcatgctctctgtcttccgcgtctacttcaacctccctttacccgaacgcttcgtccgctacacttacgagatcctcggcattcacctcacaatccgtggccaccgtcctccacctccttcccccggaaaacctggaaacctctacgttctcaaccaccgcaccgcccttgaccccattatcatcgccattgctctcggccgtaagatcacatgtgtcacttatagtgtctctcgcctctccctgatgctctcacccattcctgctgttgctctgacccgagaccgtgtcgctgacgcagcccgcatgaggcaactcctcgagaaaggtgatttggtgatctgtcctgaaggcacaacgtgtagagaaccatatctactaaggttcagtgctctatttgcagagctgagcgaccggatcgtgcctgtggccatgaactgcaagcaagggatgttcaacgggacgacagttagaggtgtgaaattctgggatccgtacttcttcttcatgaacccccgacctagctacgaggccactttcttggaccgtttgcccgaagaaatgacggtaaacggtggtggcaagactccttttgaggtggctaattacgttcagaaggtgatcggtggagttttggggttcgaatgtactgaacttacaaggaaggataagtatctgttgcttggaggcaacgacggaaaggttgagtctatcaataagaccaagtccatggagtaataatccagctagtctggttgctgctattttgcttgggagtgaagttaggtctttcgggttttcccaattacttttttttttgttttttttcatgtattgttcgaggaaaatgttttgttgaatatgcactggataatgaaactacatttgaatcaaagtacgtacatgtagtgtac

SEQ ID NO: 88 - DNA, 1817 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccat

SEQ ID NO: 89 - DNA, 1924 bp, Picea sitchensis
ccccccggtacgttttgtttgagaaggaatatggcgaagggccagagtggcctcgactgtcaagggctctttgatgtgattagcaaatgcagctccaagggccgagaaaatcagaccgtggctgcggatcttgatggcaccatgctcagatccaggagctcgttcccttatttcatgctcgtggccatggagggcgggagcctgttacgcggcatggtgctcctcgcctgcgctcccatggcctggtttctctacaacttcatctccgaagctgcggggattcagcttctcatctttatttccttcgctggactcaagatccgggatatcgagctcgtttcccgcgccgtgttgcccaagttctatgccgaggacgtgcacccggagtcatggagggtcttcagcgcctttgggaagcggtacatcgtgactgcgaatccaagaatcatggtggagcccttcgtgaagggctatttgggggctgacaaggttcttggaacggagctgcaggtttccaggagcgggcgggctaccgggttcgtgaagaagcctggtgtgctcgttggggatttgaagaaggcagctgtggaagcggaattcggtgataaattgcctgagcttggccttggggatcgagagacagatcatcctttcatgtccctctgcaaggaggggtacatggtgcccaagatgaaggtggacgaagtgcccacaaacaaactaatgagcccaatcgtcttccacgacgggcgtttggtgcagagaccgaaccccggggccgcccttctcacctttctatggctgcccataggcttctttttggctcagtttcgagtcttcggcaacattcccatcccagagaaatacgtgaaaatctcctacaagataatgggaatcaagctggtcgtcaagggaacgcctccgccggccccgaagaagaaaggcgagcggggcgtgctgttcgtatgcgatcacagaacgttgctggatcccgtgatcgtggccgtggccctgggaaggaaagttagcgccgtcacgtacagcatcagtcggttctcggagattatctcgcccattaaaaccgtccggctcactcgggaccgcgagagggacgccgctaacatcaagcgcctgctggaggagggcgacctggtgatctgcccggagggcaccacgtgcagggagcccttcctcctgaggttcagtgctctattcgcggagctcacggacaggatagtgcccgtggccatctgcaacaagatgagcatgttccacggaacaacggtgcgcgggtggaagggcttcgatccttttttctttttcatgaatccggtgcccacctacgaggtaacgttcttggatcagttgcctacggagctcacgtgcgccggaggcaaatctcccatcgaagtcgctaattacattcagagggtgctggcggccactcttggctacgagtgcaccaatttcaccaggaaggacaagtaccggatgctcgcaggcaacgatggcattgtttcccttaataagactgctactgcccgcagcaacaaccacaaacagaattgatccaccgaattccaccgaattccaggccgggtattcttaatcatgataaattttaataatctcttattaatctatgattccaattattacatactgcaaatttgaacgcgtagttaagcagaatcttcccacgaatgaatgtatacacctcataattggtatatctgtattgcaaattagatcagatcgtagttaaagaagaatcccactaatggttgcgccataattggcacatctggtcattatattgcaaattattccagtaatttgcctggactgtattatgctcaaggatcagaaataatataatgcccaaggatttttttgtccaaaaacaagaaaaaaaaaaaaaaaa

SEQ ID NO: 90 - DNA, 1765 bp, Zea mays
cgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcagcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggagaaggataagaactaacggccaacgtcgctctcttgctgctgcccagcagactgccgtttaattactgctcaaatttattccaatttattgttccttgtcgacaagttggccagtgtgatgtgggccgtgtactagtacaagcttgatgatgattagtatatctacaattcttcctttccggaagaagggcggaagagttgtt

SEQ ID NO: 91 - DNA, 1778 bp, Arabidopsis thaliana
agagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatctagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggagaaaaaaaa

SEQ ID NO: 92 - DNA, 1832 bp, Oryza sativa
ggctagctgctccgtgtctccctcgttgcatggtaagctagcatgtcgccgttcaagccgatcgagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgaccaggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtagcgaatgcttgccggcaccgacggccgtgtggagtcgaatgaggactagaaccagaagccacacgcccactattattggttccaatatatatggccaggagcctcgtttcttcgttatttctgtcacataacaagcttcaagtgcttatacgagaactgaagatgcaacatagtagaactcatgttgttcgttgtggacttgtggtataacgactttgatcatttctttgtccttttatttttacaaaaatccaagaaatatagtcatataagtttcatactgatgtaaattcttttgctatataatagatttggctatgtttttttttc

SEQ ID NO: 93 - DNA, 2529 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtccggcgtcagcgccgccgcgcggatcggcgagatcgccgtcgacagccggctaacgctgtacgtcacgcacgtcacggggcggcccagcgcgatggacacgatgatggggtccagcgcggtgcggtggttgcacaccaggagggagcccggcgtccccgggcgcggcggcggcggcggcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattagcaatttggcgccaaaacagagttagcacactaaggctgtgtttagtttcacatcaaaattgaaagtttggagaaattagaacggtgtaacagaaaagttggaagtttgtgtgtgtagaaaaattcgatgtgacagaaaagttaaaagtttaaagaaaaaagttaaatctaaacaaggcctaatttttacaaatatctggctttggagtatattcatatgtacattttgaacagttgtcttctttttttttgttaaataaaaacaaatattgatgatggactaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaaggcaattcaacaaaaagaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcgaagagcctctcgacgacctcgcgcttcttctcgccgacgaggacggccttgatgcggccggtgaaccgcttgccggaggcgaacgtctcgagctcggtgccggccacctcggcgccgaggaactcgcgcacgaactcccccaccatgacggccggcgacgcggtgaccacgacgcggcgctcggcgcagccgtggaacaccgcccacgtgtcggcgcgcaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacgaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 94 - DNA, 3320 bp, Oryza sativa
atgtcgccgttcaagccgatcaagcagtgctcgacggaggggcggtcgcagcagacggtggcctccgacctcgacggcacgctgctcctgtcccgcagcgccttcccgtactacctcctcgtcgcgctcgaggccggcggccccctccgcgcggtcgcgctgctcatgtccgtgcccttcgtctacctcacgtacgtcaccatctccgagtccctcgccgtgcgcgcgctgctgtacatcgccgtggcgggtctcgaggtgagggacgtcgagtcggtggcgcggtcggtgctgcccaggttctacgccggcgacgtccacccggaggggtggcgggtgttcagctcgttcggcaggaggtgcgtcgtgacggcgagccccagggtgatggtggagccgttcgcgagggcgttcctcggcgcggacagggtcatcggcacggagctggaggtcggcgaggacggcagggccaccggcttcgtcgccaagcccggcgtgctcatccgcgagcacaagaggaacgcggtggtgagggagttcggcgacgcgctgccggacgtcggcatgggggacagggagagcgacttcgacttcatggccatctgcaaggtacggacaaagaatattgcctattcccttaactacttactactacctaagttccaaaaatagtttgcttttacacatggacaactgcctgtctaaatgtagaaaaatgagttcttttttaaaaagtagaggtaggattgtactagcacacatgttcatattacgtgtgtcctagtatttggtacagtacatttataacggcaagtagcttatagtgcaacctgcaggcagcatatctgcatatggaattttgcgatgtggccgcccaattatgtacttagtattttttttaaaagagatgtacttagtatttcgcatacaattttgctatatatttgacgacaaattttaccacaaaaatttgacagatataattacagtacaatcgtagtgtaattacactgtaacttgcatgtaattacactgtaactatagtgtaacttgtatgtaattttcaaaaatatctccgtaacatgttatttcgataaaatgaggttgtgggaataaattctttcatatatgtgtgctatgatttgttttcttcctcaccaaaacaaatcttgtaatagatctaacgattcaaaattatgtgaaacttacatataagttacactgtagttacatgcaagttacagtgtaattacatataagttacagtgtaattacactaccactgtactataattacatctgtcaaatttttaggagaaaatttgtcgacaaatgtataggtggtccctttggcatatataagtaggttaattgcaacagtacaaacaatatattattaattccttgtactatgtaatacactgaatagtacaacgagtatgcattttgttcgttgccatttatgctgaggataattgtagtatggcattaatcgatctggaccaatctctccacgttaggtgtctgcattcaccggtgagatgatcagttgagaggtagttgtgccattgatatcgtccactgctttctcgttatcctttctctgtaggtgactctgaatctagctcttttcacggattgcatcaactgatatacgtcgtattcttcccaagttccctgcattcatgtcttatatatgctaactggacaattaatggctcatagcagggcagctgcctgtcagtgatcactccagcttggttgaatggttgagttagcctgtctgtttcatgatatctggtacaggtcccactcaataccgtttggtaggaatttatacttgtgatgtacttatgtcctcaaataagtccagggagaatatgaacgtaagcaaatttgtgattgctagacagacatgaaaaaccaaagtctagccatgcatgatctacagatttccttgtttcttccctccaactttgggaagtttgcactgaattaatacggttttgcttcatggtaggccattatatttgcaagtaatggtcctactagtataactggatcccaaatttccgatggagcatcacaatcacgatcatatgtcaagatcgatattatgctgtttggggcaaccgggcaaacatagcaccgggtaaactttggttcaacttacagttaatcagtagttaaccatgctgatatgataataagctgattagtccgtgtaagttaattaattaacctaccgggcatgcatgcaagttttggatggatttacataatggataagctggtactctgtttgtaaattctaatctactagcgtcctcaatttttttacttctccatttaaccagcgacccatgcattattctgtatttccgttgcatacttgcatttccatgcacgtgaactatgcatgacatgatgcatcttgatcaacgtggcacgtgcacgcatgcatgcaggacgcgtacgtcgtgaccacctcgcggaagcaccggccggtgccggagagccagctgctgagaaccgtcgtcctccacgacggccgcctcgcccagcgcccgacggcgatcaacacgctgctcgtcttcctctggatgccggtcggcttcgcgctcgcgctcctccgcgcgtgcctcagcctgctcctccccgagcgcgtcctctcctacgcctacaagctcacgggcgtcgggctcgtggtgcgcggccgcccgccgccgccggacgggagccccggcgtgctcttcgtgtgcaaccaccgcaccgtgctcgacccggtcgccgtcgccgccgcgctgggccgcaaggtgatctgcgtcacgtacagcgtccctcggaaaacgtacggcatgagctccaggctcccggaggcgctcacggcctcgccggtcaaggccgccgtcgcgctgtgcagggagcgcgacagggacgcggaccgtgtccggcggctgctggaggagggcgtcgacatcgtcgccttccccgagggcaccacctgccgaggggcgttcctgctgcggttcagctcgctgttcgccgagctcaccgaccgcatcgtgccggtggccatcgccaccagggagaccatgttccacggctccacggcgcgcgggtttaagggcatggacccttacttcttcttcatgaacccgcggccggcgtacgaggtcacgttcctgagccagctgccgagtgagctcacctccggcggcggcggcaagtcgccggtcgaggtggccaactacgtgcagaaggcgctcgccgggcagctggggtccgagcacatcggcatcacgcgcaaggagaagtag

SEQ ID NO: 95 - DNA, 2532 bp, Oryza sativa
tcaattggccttgggcttgtcggcggcggcggcgacccggccgtcgttgccggcgagcttcatgtacttgtccttcctggtgagcgtggtgcattggaaccctagctccttggcgatcaccctctgcacgtggttcgccacctccaccgcgctcctcccgccggcgacgcacgtctcctccggcctcagcgccggcaggaacgtcacctcgtaccccggccgcgggttcatgtagaagaagtaagggtccaggaacttccaccccctcgccgtcgacccatagtacgtcccctgcctcgcctccaccgccaccggcacgatcctcgccgtcagctccgcgaacagcgccgagaaccgcagcaggtacggctcccggcacgtcgtcccctccgggcacaccaccacgtccccctcctccagcagcgccgcgatgcgcgccgcgtccgccgcgcggtcccgcgtcagcgccgccgcgcggatcggcgagatcgccgtcgacagcggggctaacgctgtacgtaacgcacgtaacggggcggccaacgccgatggacacgatgaaggggtccgaggcggttccgtggttgcacaacaggagggagccccggcgtcccccgggcgcagcgggcgccgccgcgccccgcgcacggcgaggcggatgccggtgaggcggtaggtgtggcggacgaggcgcgccgggacggggaggttgaggaacacgcggaggagcgccacggcgaagcccacggggaggtaggccagcgcgaacagcgcgctcgctggctccgggcggcggacgaggcggccgtcgtggaagatggcgcgcgacagcagctcgtcggcggcggcgcgcggcgcgcgcttgttcttgggcaccatgtaggcttcctgcgcattggcaatttggcgccaaaacagagttagcacactaaggctgtgtttagtttcacatcaaaattgaaagttcggagaaattggaacggtgtaacagaaaagttggaagtttgtgtatgtagaaaaattcgatgtgacagaaaagttaaaagtttaaagaaaaaagttaaatctaaacaaggcctaatttttacaaatatctggctttggagtatattcatatgtacattttgaacacttgtcttctttttttttcgttaaataaaaacaaatattgatgatgggctaggttgcattctgaatgtaagcatgaaattttagtttatgatagtctaaccaattaaaaattgctagtggtcaaagttgaaacagtagagtcaatattcagagtaaatgcaaatggagagagtactaaatccacattaattgatgcaaagaaaacaatactatatgagtaaagtgatcaatgataatgatattactataacaagtcagcatgagcaaacaatatttgaatataggagtacatactaatttggggttttggttttaaaaaggacgaaataaataggaagcaactgctaactgcctactaaaggaggtgatggtaccaacagtattgagttttggccacaagttttgcataaccataatgtaaattctagagccttcttgatctttcctatgaaaagaggggaaaaaaaggcaattcaacaaaaaaaaaaggcaaaaagctaagaagcgtacatattcttgctactcgtgctaccacaaatgagccaatcggatcgaagccatgaacactcgaagaacaatcgagcgtgcaattcctaccacaattaatttcacaatattttctttttttatttttggcgttctaaatgaattgttaaattattagtggccacatgatgcaaaacttcaattttgttcatgtgtgattgattcaattcaagaaatgatgaaaatttcgagctttggatcgtaggccatgaagtgtaccttgcagatggccatgaagtcgtggtcgctctcgcggtcgccgaggccgacgtcgggcatgtcgccgccggcaaaaagcctctcgacgacctcgcgcttcttctcgccgacgaggacggccttgatgcggccggtaaaccgcttgccggaggcaaacgtctcgagctcggtcccggccacctcggcgccgaggaactcgcgcacgaactcccccaccatgacggccggcaacgcggtgacaagaacgcggcgtttggcccagccgtggaaaacggcccaggtttcggcgcgaaccccggcggcgtagtggcgcggcagcacggcgcgcgccacggcctcgacgtcgcggacgcgcagcccggcgaacgtgatgaacacgagcagggcgatggcggcggcctcggagacgccgacgtagagcgcgaggagccacggcgcggcgagcagcagcgccagcgcgcggaggtagctgccggcctcgagagccacaaggaagtagtacgggaacgccgacgacgacaccagcagcgtcccgtcgaggtccgccgccaccgtccgcctcgcgcccgccgccgcgtcgtacgccgtcaccggcggaaagaacctcctcctccccgccgccgccgccgccgccat

SEQ ID NO: 96 - DNA, 2941 bp, Oryza sativa
ctagttcttttccttctccttgttcttggaagggacgcggccgtcggtcccggcgagtatgctgtacttctccttgcgcgttatggcggtgcactcgaagccgagctggccgctgagcgtcttctggatgtagttggccacctcgatgggcgacttgccgccgctgcaagtgagctccttgggcagctggttcaggaaggtgatctcgtacgtcggccgcgggttcatgaagaagaagtaggggtccatgagcttgaagccccgcacggtggagccgtggaacatgctctccttggtgttgatcgccaccggcacgatgcggtcggtgagctcggcgaagagcgcgctgaaccgcagcaggaacggctcgcggcaggtggtgccctcggggcagatcaccaggtcgccctcctccagcagccgccggatgttctcggcgtccttctcgcgctcccgcgacagcgcgacggccttgatcggcgagatgagctccgagaacttggagatgctgtatgtgacgcagctgaccttgcggcgcagcgccacggcgacctcaaccgggtcgagcacggtgcggtggttgcagacgaagaggacgccaggatgtcccttcttggggggaggcggcgggttgcccttcacgatgaggcggatgcccatgagcttgtaggtgtagaagacgatccgctccgggagtggcaggttgacgtacacgcggaggagcgcgagcacgaagccgaacggcatccacaggaaggtgacgagcgccaccagcggcgtcggacgctgcacgaggcggccgtcgtggaggatgagtgggctcagcagctggttcttgggcaccgcgctgtacttccttgatgtcacgaggtaggcctcctgcacagacacgcagcatgcatgttacaaacacttcactgatgcaaaaatcacagcatcaccatcacttcttattttatcgaatatataaatgcttgttcatctcgccatgtacgccaaacctacatcctaccacgattacaattcagtacagtccactactgatggttccacagatgacagatcttcacatgcttaatcaaaattatgttttttcggagttaaactgttggatttaagttgacgtgtatcagccaatcaataggcgagagtagaccagagcagtggtaaagaagtacagcgattactgtaccgcaacaactgcaagactggcgcccataaatgggtgatttcccctccacgagagaaattcgttatacccccggggcagtgacagaaagacgggtcccatggagaagggaaagaaggggcaagaccatgaatggcagtatttatttcagtggttctctgcattaccggctggaagaaaggaagaaagaaagggaaagcaagggcagccgtggatctggcaggcacagccagcaccagctctgatgtctcacgcgccagccggccgatctccttcaatgcggccgggacaaggcttgaattctcaccaaacaaccgtaaataatggagccagccagccggccggacggactgactcgaccgtggcatactggcatgagtgaatccacgcattcaatccggcgggccacgggcgagtaaaaaccatcggcttccttccatgctctggctctgcccgcctccagattccttttctgatcatttgctcgagctttcgagttgttaagcttcaggtgaggatctagtatgtgcgacgtagacgttttgtgagttctgataatgaccttgatccttattattagtttactgattaaggatgttggtggaacagagcgaccggtcagtgcaggaagcttaaactgggtttcgcataatgggctgagcaacatctacagatcagtgtcataaatggcctgacaatgactatacacccctgctgttcgcgtgctcgaccactgtggcatactctactctgatctgaaaccactctactctgatctgaaacctctgcatgtttgtacagattgcagaatttatagtaggcggtgttcatagcttcgtcatagcaaaaatcaattgtaactgatgtgctaattccacgttatgaaagtaatatgtgtgatggagactatacttaattccaattttcatgtttcttgtttggaatgcagtaattccgaaataaacagagcattctatacggaatttatgtacaagatggtctaaccagttcgtagttgccagtaattggcagtgctactactaattcgtcgcaggacttgatcactgcaattaacaatcaacacgacagtactattactatgagcaaaaaatgagtttgagggggcgtcaaatttaccttgcatatggacatgaagtcgaaatccgtctccctgtcgcccaagccgacgtcgggcaccgcgtcgcgtagctccttgacgacggcctgcctcttgtggtcgcccacgagcactccgggcttcaccatgaaccccgtggccttgccgttcttgccgacctccagctccgtcccgaccaccttgtcggcgccgaggaacgtcttggcgaagtgctccaccatgatcctggggctcgccgtgatgatgtaccgcttgccgaaggagttgaacaccctccagctctccgggtgcacgtcctccgcgtagaacttgggcagcaccgaccgcgccaccatctcgatgttcctcaccttgagccccgccacggagatgtacaccagcgtgctgatggccagcgactcggagaagaaaatgtaggtcacgtagacgaacggcacggacagcagcagcacgacggcgcggagcacgctgccggcctcgagcgcgacgaggaggtagtacgggaaggcgctccgcgacctgaccagcgtgccgtcgaagtcggcggccaccgtctgctccgacctcccatccgagctgcactcctccacgggcttgaacctccgcgacaccat

SEQ ID NO: 97 - DNA, 1930 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctctgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaactttttgacaatgttagccgagttggcatcatacaggtctggctagcctaacagcgttgtcctgccacaccactctaggtaacgtggcagaacaaaactgtcacgcttgacacgacagtgtcattttgccatgttagacacaggctggcgtaattaaaatgttcaactttctaaaataagctatagaatagtttgtttttaatataaaaaaagaaaaattcaaaagttaatataaattccatgcaccggcgagttagctggtgagctagttgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcgcggtgagcacgcaccggcgcccgcacgccgagaacacgcgccacgactccgggtggatgtcggagcagtagaacttgggcagcacggcgcgcgccaccgcctcaacgtcggcgaccctcgcgccggccatggacgcgaagatgagcacctggatgccggccgactcggacaccaggtagtagagcacgccggcgagcggcgccagcaggatcagcgccagcagccggaggacgccccccgtctcgaacgccatgtgcgcgaagtacgggaacgagctccggccgcacagcagcgtgccgtcgaggtcggcgacgatcgtgtcgccgccgcggtccttggacgaacacttctccaccgccgggaacggcgacgcgatcat

SEQ ID NO: 98 - DNA, 1960 bp, Oryza sativa
ttaacatcccatggccttcttctcgtcgatgttgggcttggacacgacggtgccgtcgttgccggcgagcgccctgtacttgtccttcctggtgaagctggtgcactcgtaggagagcgtggaggcgatgagcctctggatgtagttggccacctcgtggctgctccggccgccgccgccgccgccaccgccgttgcaggtgagctcgccggggagcttgctgaggaaggtgaccacgtatccggggctagggttcatgaagaagtagaaggggtccagcgccttccaccccctcgccgtcgtgccgtggaacatgctcatctggttctccatcgccaccggcacgatctcgtcggtgagctccgcgaacagcgccgagaaccggaggaggaacggctcccggcacgtcgtcccctccgggcagatcaccaggtcgccctccgccagcagccgccggatcatcgccgcgtccgccgccctgtcccgcgtcagccgcaccgtcctgatcggcgacaatatctccgacagccgcgacacctgttcagacacgcaccaagatttttatttttaaaattttgaacaacttaaattttaaaatttaaaaataaacctttctaagatttattatcaacatctaaacttttttgaccatgttagccgagttggcatcatacaggtctggctagcctaacagcgttgtcctgccacaccaccctaggtaacgtagcagaacaaaactgtcacgcttgacacgacagtgtcattttgccatgttagacacaggctggcgtgattaaaatgttcaactttctaaaataagctatagaatagtttgtttttaatataaaaaaagaaaaattcaaaagttaatataaattccatgcaccggcgagttagctggtgagctagctgctcgccggagttggtggtggtgtgatcatgtgtactaccgagtaggtgacggcggtgatggggcggccgagggcggtggagaggaagatggggtcgaggagggtgcggtgggagcagatgaagagcacgccggactggccggtctcgcggctggccggtggcggcggggtgcccttgacggtgacgcgcacgccgagggcgcggaaggcgtggtacaccacgcgcatcgggaggagcgcgccggcggcgatgcggaggcaggcgagcacgaagccgatggggatccagagcacggtgagcagcgcgagcgccggcgacggcttctggaccaggcggccgtcgtggaacaccaccggcttcgggagctcctcccgcggcacgggcctcggcgtcggcgacaccggcaccacgtacccctccttgcatagcctcatgaacgggtagtccgtcctccggtcgccgatgccgatctccggcgaggcgtcgccgaacgcctcccggagcgcggccgccttgttctcgccgacgagcacgccggggctccggacgagccccgtggcgcggccacgccagaccacgagctccgtgcccacgacgatgtcggcgccgaggtactccttcaagaacgcctccaccatcatcctcgggttcccggttaacaaggcaccggggcccggcaagccgaaaaaaagggccaagaatccgggtggatttcggagcattagaacttgggcagcacggcggggggcaccgccttaaagtcggggacccttgggccggccatggacgcgaagatgagcacctggatgccggccgaatcggaaaccaggtagtagagcaagccggcaaacggcgccagcaggatcagcgccagcagccggaggacgccccccgttttgaacgccatgtgcccgaagtacgggaacgagctccggccgcacagcagcgtgccgtcgaggtcggggacgatcgtgtcgccgccgcggtccttggacgaaaacttttccaccgccgggaacggcgacgcgatcatcggggggtcccccat

SEQ ID NO: 99 - DNA, 2311 bp, Selaginella moellendorffii
cttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcgtccagttcggcctcgtggagaattgctcatctgaaggacgtggaatgcacacggttgcggcggatttggatggtacactgctcagacgcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggataaagttattgggactgaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcctgggattggccgccgagagggacgtgaccgggctcacttacagcatcagccgggtgtccgaggtgctatcgcccatcgtcacggtccggctgacgagagacaaggagcgcgactttacgaagatgaagtcgctgctggagagggggagggacctgtgcctgtgtccggaggggacgacttgccgtgagccgttcttgctgcgattcagcgctctcttcacccagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgcggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttggctggtgttgacttgaattgactagagttgacggttgaatactttttttttagtgttggctggctatctagcttgcactagtaaatgctaaaggttataggcaggcgattttaatccttccacatggctgggacaggaaatattgacttcgttcaattaaagggggaaaggttttagggcaggggtgttctagggcacggcagcgagctggcatcctcacaccggcagcatggcgtccggccggcggtacggcgctcgtgtctcgcattgccagagaaatgccactcccaacctccgccaccttttctctctccgccacctttgcgaactaaacaaatgtgttagaggaatcaaagatccaacacaccgaaacttcgtttttgttttcttcttgcctggtctttgtggaggcgaagaaaaaaaggaaacgagagagtctttgtacctttgggaatcaaactgctattgcgta

SEQ ID NO: 100 - DNA, 1989 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggagcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgttgtcttccacgacggccgcctcgtccagcggcccacgcccttgaccgccctcgtcaccttcctgtggctgcccgtcagcttcgtgctggcggtgttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgatcaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgtttctccagcagctgccgccggagctgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgttccggagaggcggaggagcggcggcggaggtggcggcgccgccaaggatctcccgaaggacgagcaagcggcccaggggcaagaccaggtaaatggctgtagctaaaattgatttgcgaggatcgtggatccatgccatgggtcgggtctcacgcgctccttcgttataagtgaatgtaagctaagctactggcttgctctct

SEQ ID NO: 101 - DNA, 1554 bp, Selaginella moellendorffii
atggcagagtttccacccatcgaaaagtgtggcaccacaatcagccgcgagagcgaatcggtggcctccgatctggatggaacgctgctgcgcgggaggagttccttcccatactttttcctcaccactttcgagacgtcggggatcttgcgctcctggctgctcctcctcgtctcgcctctcgtctggcttctctatcacttcatctccgaggccgctggaatcaagctcctcatcttcgcttccctggcgggtgttccagtctctcagatcgaatgcatcgcccggagtgttcttccgcggttttatctccaggatctcaaccccgagacgtggaaggtcttctcgtcctttgggaagaagattgttgtcacagcgaatcccaggatcttggtggagtcgctctgcaaggaattcctaggtgctgacgaggtgattggaaccgagctggaggtggataaccgaggacgagcaaccggtttcgtcaagagccccggagttctcgttggagagaacaaagccaaggccttgctccaggcctgtgatcccgagcagctcccagacgttggacttggcgatcggcagaccgatttcccgttcatgaagctttgcaaggtacgtaacaaaagatcgtccctccttcccgcgacttagcagttctcacgctggcttctctcaatccaggaaggatacgtcgtccccccaagcaacaacgtggagccagttccaaagtcccagcttctgaagcccatcatctttcacgatggtcgtctcgtccagcttccgacgccactcgtggctctcgtcaccctcctctggatccccgtcggcttcgttctagcctgcctccgaatcgccgcaggctcgctgcttcccatgtcaatcgtgtaccatgccttctggctgctgggagtccgagtgaccgtgaaaggaacgccacctccgagagccaccaagaactcccgaggcgtcctcttcatctgctcgcaccggacgctgctagatccaatcttcctgtcgtgtgcgctgggccgaggcgtctccgccgtgacttactcggtgtcccgactgtccgagatcctcagcccgatcaaaacagtggctctctccaggaaccgctacaaggacgcggctcagatccgggagctcctgaaagaaggcgacctggtaatctgccccgagggaacgacgtgtcgggagccattcctgctgcgtttcagcgcactgttcgcggagctggccgacgatatcgtccccgtcgccatggacaaccggatgagcatgttccacggcaccgctgctcgtgcctggaaggggatggacccattctacttcttcatgaatcccagccccagctacgaggtaacgttcctccagcagctcccggaagagctcacttgcaagggcggcaagagctcccacgaagtcgcaaaccatatccagcgagctctggcgggagtgctagatttcgagtgtaccaatctgacgaggaaggacaagtacaaggcgctcgtcggcacggacggatcggtggagaccaagaagtcaacgtga

SEQ ID NO: 102 - DNA, 1554 bp, Selaginella moellendorffii
tcacgttgacttcttggactccaccgatccgtccgtgccgacgagcgccttgtacttgtccttcctcgtcagattggtacactcgaaatccagcactcccgccagagctcgctggatatggtttgcgacttcgtgggagctcttgccgcccttgcaagtgagctcttccgggagctgctggaggaacgttacctcgtagctggggctgggattcatgaagaagtagaatgggtccatccccttccaggcacgagcagcggtgccgtggaacatgctcatccggttgtccatggcgacggggacgatatcgtcggccagctccgcgaacagtgcgctgaaacgcagcaggaatggctcccggcacgtcgttccctcggggcagattaccaggtcgccttctttcaggagctcccggatctgagccgcgtccttgtcgcggttcctggagagagccactgttttgatcgggctgaggatctcggacagtcgggacaccgagtaagtcacggcggagacgcctcggcccagcgcacacgacaggaagattggatctagcagcgtccggtgcgagcagatgaagaggacgcctcgggagttcttggtggctctcggaggtggcgttcctttcacggtcactcggactcccagcagccagaaggcatggtacacgattgacatgggaagcagcgagcctgcggcgattcggaggcaggctagaacgaagccgacggggatccagaggagggtgacgagagccacgagtggcgtcggaagctggacgagacgaccatcgtgaaagatgatgggcttcagaagctgggactttggaactggctccacgttgttgcttggggggacgacgtatccttcctggattgagagaagccagcgtgagaattgctaagtcgcgggaaggagggacgatcttttgttacgtaccttgcaaagcttcatgaacgggaaatcggtctgccgatcgccaagtccaacgtctgggagctgctcgggatcacaggcctggagcaaggccttggctttgttctctccaactagaactccggggctcttgacgaaaccggttgctcgtcctcggctatccatctccagctcggttccaatcacctcgtcagcacctaggaattccttgcagagcgactccaccaagatcctgggattcgctgtgacaacaatcttcttcccaaaggacgagaagaccttccacgtctcggggttgagatcctggagataaaaccgcggaagaacactccgggcgatgcattcgatctgagagactggaacacccgccagggaagcgaagatgaggagcttgattccagcggcctcggagatgaagtgatagagaagccagacgagaggcgagacgaggaggagcagccaggagcgcaagatccccgacgtctcgaaagtggtgaggaaaaagtatgggaaggaactcctcccgcgcagcagcgttccatccagatcggaggccaccgattcgctctcgcggctgattgtgctgctacacttttcgatgggtggaaactctgccat

SEQ ID NO: 103 - DNA, 1757 bp, Selaginella moellendorffii
atggagcacccgtatgacgtgatcgacaattgctcggccgacaaccgcgagaagcagagcgtggtagccgacttggatggctcctgcgttcgcagccggagctccttcccttacttcatgctggtggctctggaaggaggcagcctcctgagaagcgtgctcctcatggtcatggcccccgtcgcgtggctgctctaccacttcgtctcggaggcagcaggcatcaaagtcctcatcttcttctcctgcgccggccagagagctcgggacatcgaagcggtggctcgcgcagttctccccaagttctactccgaggacgtccacagctccacctggagagtcttctcgtcgtgcggcaagcgctacattctcacggccagcccgagactgatggtggagcactttgccacgacatacctgggcgctgacaaggtgatagggacggagctgcaagtgacaaggagcgggtacgctacggggttcgtcaagagccccggcgttttggttggcgtcaacaagaggcgggcattgaaggccgtgtttggtgaggaggtgccagacctggggattggcgatcgcagctctgattatccgttcatggctttttgcaaggttggtacttctcgttctctctgagctctcttccttttcgcctgtagtcagcaggagcatatgcatatattgcagtgcatgctatgctagtctgtgatctttggagcaactcgtcgcctggctttctttttctttgattttgttgtatggttgttggtgtcaagtccgcgttgtcttcgttgtctccgtcgtcttctggctttatttcatccacggatgtggaacttccgagtctcaccagaactaataaagtcgcctctcttttttccttttcggctttgcaggaagcttacattgttcctagccagcctgccgacgccgttccagctcacaaactcgcgcgcaagattatctttcacgacggcaggctggtccagaggccgacgccgttcgtggcgctggtcacctttctgtggctacccgccggcttcctcctggccttcttccgcatcctggtggcgcttccatgcccggtcgagtacgtcccgctgctctacaaggtgatcggcgtccggctcatcgtcaagggcaaagtcccgccaccttccaagaacgggatcctcttcgtctgcacgcaccggacgctcatcgacccgataatggcctcggcggcctcggggagcgacgtgaccgcgctcacctacagcattagccgggtgtcggaggtgctctcgcccatcaagacggtgccgctgtcgcgggaccgggagagggacgcctcgaacatcaagcggctgctgctgaaggagaacttggcgatctgtcccgagggaacgacgtgccgggagcctttcctgctgcggttcagcgccctgttcgcggagctgtccgagaacatcgtcccggttgcgacgtcgaccaaaacgagcatcttccacgggacgacggtgcggggctggaaggggatggacccgttcttcttcttcatgaacccgttcccggtgtacgaggtgacgttcctcgagcggctgccgcacgatctgagcgtccaggggggcaagtcggcgatcgaggtggccaactacatccagagggtgctggcggacacgctgggattcgagtgcacgaactttacgcgcaaggataagtatgggatgctcatcggcagcgatggaacggtgcctgccaggaagaagtccttttga

SEQ ID NO: 104 - DNA, 2256 bp, Selaginella moellendorffii
agcttctgagccagcagtacaggggctggacggacttgaaaggcatttttctccagttccatttcaagtgagcacgttggaagcatttattctcctctgtggcgttctttctaactcggagttgtcccaggattcgacatggccgacttaaagtactcgcggctcttccggttcggcctcgtggagaattgctcatctgaaggacgtggaatgcacacagttgcggcggatttggatggtacactgctcagaggcagaagctcgtttccatacttcctgctggtggctcttgaaggaggtagcctcttcagagcagttgttctcggacttttggcccctatcgcctggctgctttaccacttcgtctcggaggcagcagcaattcaacttctcatctatgtctctttttcggggcagaaggtgtccgagattgagaaggtggcaacggcggttctgccgaagttttactcccaggacgtccacagtgatgctttcagagttttctcgtcctgcgggaagaagtatgtcatcactgccaatcctcggatcatggtggagtatttctgcaaggccttccttggcgcggacaaagttattgggacggaaatcgaagtggacgatgatggacgtgctacaggcttcgtcaagttcccaggtgtgctcgtgagtcaaaacaagaggaccgccttgaagctcgagttcgtggacggggagcttcccgagatcggactcggcgatcgagaaaccgacttcgccttcatgtcgctttgcaaggtaagcgcactctttccatatcatatacatattttgcatttcgagcatataatacttagctctgcctctttcgtgctgctttaactgttgaggggtgccaggatttgcgtgacactccagaatcagttacgagaagcgagttttctaactctggttgtaaccgtgtgatacaggaagcttacgttgttcccaagaggaaggttgacgcagtggacggcagcgctctggcgcagcgcgtgatcttccatgatggtaggctggtccagctcccaacgccgttcgtggcgctcgtcactttcctctggctccctatcggcttcgcgctcgcagtgctccggatcggcctcacctcccgttgcccccgaaagtacatgggaatgatctacgccatcctcggcgtccgccgcatcaccaaaggcaaagttcctcgcaaacaagacggcagggggctcctcttcgtgtgcaaccacaggactctggtggatcccatcttcgtgggattggccgccgagagggacgtgaccgggctcacttacagcatcagccgggtgtccgaggtgctatcgcccatcgtcacggtccggctgacgagagacaagcagcgcgactttacgaagatgaagtcgctgctggagagggggagggacctgtgcctgtgtccggaggggacgacttgccgggagcctttcttgctgcgattcagcgctctcttcaccgagctcacgcacaggatcgtcccggcggccgtgaagacgaggcagagcatgtttaacgggacggcggtgcgggggtggaaggggatggatccattcttcttcttcatgaatccattcccgacgtacgaggtggagtttttggaggagctccccgtggagatgagcgtccaaaagggcggcaagagctcgttcgagacggccaatttcatccagaagatgctgggcgacaagctgggatacgagtgcacgaccttcacccgcaaggacaagtacctgatgctcaatggcagcgatggaacagtccccacgaaataggaaggggttggaaaagaaaacaagatggaaccgttgactggtgttgacttgaattgactagagttgacggttgaattttttttttttggtgttggctggctatctagcttgcactagtaaatgctaaaggtttttcaagcaggcaggcgattttaatccttccacatgggtgggacagaaaatattgacttcgttcatttaaagggggcaaaggttttagggcacggaggggtggtctagggcacggaagcgagctggcatcctcacacaggcagcatggcgtccggccggcggtacggcgctcgtgtctcgcattgccagcgaaatgccactcccaacctccgccaccttttctctctcctggagttcttctgccacctttccgaactgaacaaatgtgttagaggaatcaaagatccaacacaccgaaacttcgtttttgttttcttct

SEQ ID NO: 105 - DNA, 2044 bp, Selaginella moellendorffii
atgtcgctcgacggcggcaaggtcacggattctttcctggtagatgctccattcgagccggtggagcgatgctcgtcggcggggcgtgagaagcagacgtgcgtggcggatttcgacggtactctcatccgcggccggagctccttcccgtatttcatgctggtggcgctagagggaggaggcctcatccggagcgtgattcttggcctcttcgcgccgctcgcctggatcctctaccatttcgtctcggaatccgccggcatccgcctcctcatcttcatctccttcgccgggatgaaggccaagcagatcgagtcggtgtcgcgcgccgtgctgcccaaattctactcggaggacgtccacagcgaggcctaccgagtgttctcctcgtgcggcaagcgtgtggtggtgaccgccaatccccggatcatggtggagcacttcgccaagacgtgcctgggggcggacaaggtgctggggaccgagattgaggtgacgaggagtggctacgcgacgggattcctcaagcggccgggagttctcgtgggggtcaacaagcgcaaggctgtgaggcaggaattcggcgagcatttgccccatgtcggcattggcgatcgagccacggactttgctttcatggcgctctgcaaggtacttatctcgaatccaatcccgctctgcttggtgggtggagtggttgcttagttctcgatcgagctcgatgcattagatcaacactctgggcattgttttcgatcgatgatccatccctgcaattgctgcatgagtggatgattctcttgtttcttttgtttatcttttttccttgtctcatgcacacattcttacaagcgcactagcactagcctaaaagaatctcttccaagcagcagtagaaacttctttccagtcaactaacgaacccatttgctgaccactatcaggaagcatacgtcgtcccaccctccaaagtggaggcgctgagccgagacaagctcgtcaagcccgtcgtcttccacgacggccgcctcgtccagcggcccacgcccttgaccgccctcgtcaccttcctgtggctgcccgtcagcttcgtgctggcggtcttccggatcatggtcacggtaccctgcccgcgcgagtacgtgaccatcgtctacaagctcgtcggcatccggctcatcgtcaaggggccgatcccgccgcccaagaagcggggcgagtccggcgtgctcttcgtctccagccacaggacactgtgcgatccggtgttcgtgggggtcggggcccggcgggaggtgacggcgctcacctacagcatcagcagggtgtcggagttcctgtccccgattaagacggtgggcctgtccagggaccgcgagagggacgcggccaagatcaaggcgctgctccagaagggggacctgtgcatctgtcccgagggaaccacctgccgcgagccattccttttgcgattcagcgcactgttcgcggagctgactgacaagatcgtgccggtggcgctgtgcacgaaggggagcactttccacgggacaacggtgcgcgggtggaaggggttggatccattcttcttcttcatgaatcccttcccgacgtacgaggtgacgttcctccagcagctcccgccggagttgacggtccagcagggcggcaagagcgcgatcgaggtggcgaatcacatccagcgggtgatcgcggacacgctgggattcgagtgcacgaacttcacccgcaaggacaagtacgggatgctggcggggaacgacggcaccgtgccggagaggcggaggagcggcggcggaggtggcggcgccgccaaggatctcccggaggacgagcaagcggcccaggggcaagaccaggtaaatggctgtagctaagattgatttgcgaggatcgtggatccatgccatgggtcgggtctcacgcgctccttcgttataagtgaatgtaagctaagctactggcttgctctctcgattgactcatcaggaatagatcgatcgggtggagagcatcgtgatcg

SEQ ID NO: 106 - DNA, 1715 bp, Oryza sativa
actcccacaccatcagcgagcacctagcggtcgcatcgctagctgccatctcctggtgagatccatcgagacgcccggcacgacgacgatggtgtcgcggaggttcaagcccgtggaggagtgcagctcggatgggaggtcggagcagacggtggccgccgacttcgacggcacgctggtcaggtcgcggagcgccttcccgtactacctcctcgtcgcgctcgaggccggcagcgtgctccgcgccgtcgtgctgctgctgtccgtgccgttcgtctacgtgacctacattttcttctccgagtcgctggccatcagcacgctggtgtacatctccgtggcggggctcaaggtgaggaacatcgagatggtggcgcggtcggtgctgcccaagttctacgcggaggacgtgcacccggagagctggagggtgttcaactccttcggcaagcggtacatcatcacggcgagccccaggatcatggtggagcacttcgccaagacgttcctcggcgccgacaaggtggtcgggacggagctggaggtcggcaagaacggcaaggccacggggttcatggtgaagcccggagtgctcgtgggcgaccacaagaggcaggccgtcgtcaaggagctacgcgacgcggtgcccgacgtcggcttgggcgacagggagacggatttcgacttcatgtccatatgcaaggaggcctacctcgtgacatcaaggaagtacagcgcggtgcccaagaaccagctgctgagcccactcatcctccacgacggccgcctcgtgcagcgtccgacgccgctggtggcgctcgtcaccttcctgtggatgccgttcggcttcgcgctcgcgctcctccgcgtgtacgtcaacctgccactcccggagcggatcgtcttctacacctacaagctcatgggcatccgcctcatcgtgaagggcaacccgccgcctccccccaagaagggacatcctggcgtcctcttcgtctgcaaccaccgcaccgtgctcgacccggttgaggtcgccgtggcgctgcgccgcaaggtcagctgcgtcacgtacagcatctccaagttctcggagctcatctcgccgatcaaggccgtcgcgctgtcgcgggagcgcgagaaggacgccgagaacatccggcggctgctggaggagggcgacctggtgatctgccccgagggcaccacctgccgcgagccgttcctgctgcggttcagcgcgctcttcgccgagctcaccgaccgcatcgtgccggtggcgatcaacaccaaggagagcatgttccacggctccaccgtgcggggcttcaagctcatggacccctacttcttcttcatgaacccgcggccgacgtacgagatcaccttcctgaaccagctgcccaaggagctcacttgcagcggcggcaagtcgcccatcgaggtggccaactacatccagaagacgctcagcggccagctcggcttcgagtgcaccgccataacgcgcaaggagaagtacagcatactcgccgggaccgacggccgcgtcccttccaagaacaaggagaaggaaaagaactagcgagtcacagcctcctatcgatcggagtactccgtattcgcccagccgactagtgtcactcatggcttctatctattgtttacgatttattgttgtttttcaagaagttggtaaattacatattgtttccgag

SEQ ID NO: 107 - DNA, 1521 bp, Oryza sativa
atggcggcggcggcggcggcggggaggaggaggttctttccgccggtgacggcgtacgacgcggcggcgggcgcgaggcggacggtggcggcggacctcgacgggacgctgctggtgtcgtcgtcggcgttcccgtactacttccttgtggctctcgaggccggcagctacctccgcgcgctggcgctgctgctcgccgcgccgtggctcctcgcgctctacgtcggcgtctccgaggccgccgccatcgccctgctcgtgttcatcacgttcgccgggctgcgcgtccgcgacgtcgaggccgtggcgcgcgccgtgctgccgcgccactacgccgccggggtgcgcgccgacacgtgggcggtgttccacggctgcgccgagcgccgcgtcgtggtcaccgcgtcgccggccgtcatggtgggggagttcgtgcgcgagttcctcggcgccgaggtggccggcaccgagctcgagacgttcgcctccggcaagcggttcaccggccgcatcaaggccgtcctcgtcggcgagaagaagcgcgaggtcgtcgagaggctcttcgccggcggcgacatgcccgacgtcggcctcggcgaccgcgagagcgaccacgacttcatggccatctgcaaggaagcctacatggtgcccaagaacaagcgcgcgccgcgcgccgccgccgacgagctgctgtcgcgcgccatcttccacgacggccgcctcgtccgccgcccggagccagcgagcgcgctgttcgcgctggcctacctccccgtgggcttcgccgtggcgctcctccgcgtgttcctcaacctccccgtcccggcgcgcctcgtccgccacacctaccgcctcaccggcatccgcctcgccgtgcgcggggcgccgccgccgccgccgcgcccggggacgccgggctccctcctggtgtgcaaccaccgcaccgcgctggaccccatcatcgtgtccatcgcgctgggccgccccgtgacgtgcgtgacgtacagcgttagccggctgtcgacggcgatctcgccgatccgcgcggcggcgctgacgcgggaccgcgcggcggacgcggcgcgcatcgcggcgctgctggaggagggggacgtggtggtgtgcccggaggggacgacgtgccgggagccgtacctgctgcggttctcggcgctgttcgcggagctgacggcgaggatcgtgccggtggcggtggaggcgaggcaggggacgtactatgggtcgacggcgagggggtggaagttcctggacccttacttcttctacatgaacccgcggccggggtacgaggtgacgttcctgccggcgctgaggccggaggagacgtgcgtcgccggcgggaggagcgcggtggaggtggcgaaccacgtgcagagggtgatcgccaaggagctagggttccaatgcaccacgctcaccaggaaggacaagtacatgaagctcgccggcaacgacggccgggtcgccgccgccgccgacaagcccaaggccaattga

SEQ ID NO: 108 - DNA, 1755 bp, Zea mays
aacccagacaggcaccgtaccaccgtgttccccgtcgccatggccgcgaggttccccccggtgtcgtcctacgacgcttcggcgcgggtccgccgcacggccgcggcggacctggacggcacgctgctggcgtcgtcgtcggcgttcccctactacttcctggtggcgctggaggccggctcctgcgcgcgcgcgctgctgctcctcctggccgcgccgctgctgctggcgctctacacgctggtctccgaggcggcggccatcgcgctgctggcgttcgtcacgttcgcggggctccgggtgcgcgacgtcgaggccgtcgcccggggcgtcctcccgcgccactacgccgcaggcgtgcgcgccgacacctgggccgtgttccgcgactgcggcgccgcgcggagggtcgtcgtcaccgcgtcccccgccgtcatggtcgccgacttcgtccgcgagttcctcggcgccgagctcgccgccaccgagctcgagacctgccgcgcgctcggcgacgcctggttcacgggcaggatcaaggccgtgctcgtcggggagaggaaggccgaggtcgtgcgccggctcttcgccgccggcgacctgcccgacgtcgggctcggggaccgcgagagcgaccacgacttcatggccatctgcaaggaggcttacatggtgcctccggaccggcgcgcgccgcgagcggccgcggacgcgctgctgtcccgcgccgtcttccacgacggccgcctcgtgcggcgcccggacccggcgcacgcgctcttcgcgctggcctacctccctctcggcttcctgctggcgctgttccgcgtgctcttcaacctcgccatgccggcgcgcctggtccgccacacgtaccgcctgacggggatccggctccgcgtgcgcgggactccgccgccggccccggcgccgggcgcgccggggtcgctgctggtgtgcaaccaccgcacggcgctggaccccatcatcgtgtcggtggcgctggggcggcccgtggcgtgcgtgacctacagcgtgagccggctgtcgacggcggtgtcgccggtccgcgcggtggcgctgtcgcgggaccgggcggccgacgcggcgcgtatagcggcgctgctggcggagggcgacgtggtggtgtgccccgaggggaccacgtgccgggagccctgcctgctgcgcttctcggcgctgttcgcggagctcacggaccggatcgtgcccgtggcgctggacgcgcggcaggggacctactacgggtccacggcgagggggtggaagtggctcgacccttacttcttctacatgaacccgcgccccgggtacgacgtcaccttcctgccgccgctgcggccggaggagacgtgcggcgccggcgggaggagcgccgtcgacgtggccaaccacgtgcagacgctcatcgccaaggagctcgggttccggtgcaccaagctcaccaggaaggacaagtacatgaagctcgccggcaacgacggcacggtcgggggcaggcctgagaatgagaagggcgccgccgatgatagtgctgccacggccaccaccaagaagcttgtataaagagactgtatttatagctagctggtcgactgtatcggagcagcatccattatgtatttatgtacgtatgctaatgacgacaacattagtgtgatgtgatggattcgtgaacatagaagattacaagcttaacttcatgtttaccatgaccaaaaaaaaaaaaaaaaa

SEQ ID NO: 109 - DNA, 1852 bp, Zea mays
gcgcgcgtatattaactccacctcgccgccccactccactgccaagcaactcgcacgcagcagtacgacgtctctcctctgggtctggggccgagacaccgagcacgtactaccagcaagatggtggcgtctcccagattcaagcccatcgaggagtgctgctcggaggggcggtcggagcagacggtggccgccgacctggacggcacgctgctcatctccaggagcgcgttcccctactacctcctcgtggctctcgaggccggcagcgtcctccgcgccgcgctgctgctcctgtccgtgccgttcgtctacgtcacctacgccttcttctccgagtcgctggccatcagcacgctggtgtacatctccgtggcggggctcaaggtgcgcarcatcgagatggtggcgcgctccgtgctccccaggttctacgcgggcgacgtgcacccggagagctggagggtgttcagctccttcggcaggcgctacgtcgtcacggccagccccagggtcatggtcgagcccttcgccagggccttcctcggcgccgacaaggtcgtcgggaccgagctggaggtcggcagggacggcaaggccacgggcttcatggccaggccaggcgtgctcgtcggcgaccacaagaagaaggccgtcgtcaaggagctcggcgacgcgctgcccgacgtcggcatgggggatagggagaccgacttcgacttcatgtccatctgcaaggaggcctacctggtgacgtcaaggaagtacagcccggtgcccaggaaccagctgctgagcccgctgatcgtgcacgacggccgcctcgtgcagcgcccgacgccgctcgtcgcgctcgtcaccttcctctggatgccgttcggcttcgcgctggcgctcatgcgcgtgtacatcaacctgccgctgcccgagcgcatcgtctactacacctacaagctcatgggcatcaggctcgtcgtcaagggcaccccgccgccgccgcccaagaagggccacccgggcgtcctcttcgtctgcaaccaccgcaccgtgctcgaccccgtcgaggtggccgtggcgctgcgccgcaaggtcagctgcgtcacctacagcatctccaagttctccgagctcatctcgcccatcaaggccgtcgcgctgtcgcgggagcgcgacaaggacgccgagaacatccgccgcctgctggaggagggcgacctggtcatctgccccgagggcaccacctgccgcgagcccttcctgctgcgcttcagcgcgctcttcgccgagctcaccgaccgcatcgtgcccgtggccatcaacaccaaggagaccatgttccacggctccaccgtgcgcggcttcaagctcatggatccctacttcttcttcatgaacccgcgcccgacgtacgagatcacgttcctcacccagctccccaaagacctcacgtgcagcggcggcaagtcgcccatcgaggtggccaactatatccagaagacgctcagcggacagcttggcttcgagtgcacgtccatcacgcgcaaggagaagtacggcatgctcgctggcaccgacggccgtgtcccgtccaagaacaaggagaaggagaaggataagaactaacggccaacgtcgctcttcctgcttgcccagaagactgccgtttaattactgctcaaatttattccaatttattgttccttgtcgaaaagttggccagtgtgatgtgggccgtgtactagtacaagcttgatgatcattagtatgtctacaattcttcctttccggaagaagggaggaagagttgatagagccgtcttaatacaaagtttcgccaaaaaaaaaaaaaaaa

SEQ ID NO: 110 - DNA, 1704 bp, Zea mays
caccaatataatcaccatttctgttcacgcgatcgagaggcaaaattaagcatggtgtcccgaaggttcaagccgatcgagctgtgcgactccgaggggcggtcgcgccagacggtcgccgccgacctcgacggcacgctcctcctgtcccgcagcgcgttcccgtactacctcctcatcgcgctggaggccggtagcctccttcgcgcggtggcgcttctcttgtccgtgcccctcgtgtacctcacctacgtgaccgtgtccgagaccctggccgtgcgcgcgttcatctacgtcgccatggccgggctggaggcgagggacatcgaggccgtcgcccggtccgtgctccccagcttctacgccggcgacgtccacccggagggctggcgcgtgttccgctcgttcggcaggaggtgcgtcgtcaccgccagcccgcgcctcatggtggagccgttcgccaaggcgtttcttggcgcggacgtggtgatcgggacggaggtggaggtggcccagtccgggaaggccacggggttcgttgccgggcccggggtgctcgtcggcgagcacaagaggcgggcggtggcgagggagttcggcgactcgctgccggacgtcggcatgggggatcgcgagagcgacttcgacttcatgtccatctgcaaggaagcgtacaccgtaacacgacagaagtaccgcgcgctgccccgggatcagctgcagggccgggccatcctccacgacggccgcctggcccgccgcccgacggcgaccaacgcgcttctcactttcctgtggatgccgctcggcttcgcgctcgcgctggtgcgcgcgcatctgcacctgctcctcccggtgcgcgccctcgcctacgcctacaagcttacgggcgtcaagctggtggtgcgcggcaacaggccgccgccgtccaagaagaagaagggcgaccagctaggggttctcttcgtgtgcaaccaccgtagcacgctcgacgccgtcgcggtgggcgtcgcgctgggccgcaaggtgagatgggtcgtcacagacggcggtgcgggtgcctccaggttctcggagcccgtagtgtcgcctatcatgacaggcgtgccgctgcccgtgcccaccagcctcgagggcgacgccgacgcggacgccgccccccgcatccggcggctgctcgaggagggagacgacgtcgtcgtcttccccgagggcgccatctgccgcgagccgttcctgctgcggttcggcgcgctcttcgctgaggtcaccgaccgcatcgtgcccgtggccatcgaacctagggagagcatgtttcacgggtccacggcgcgcgggctcagagggatggatccctacttctttttcatgaacccacggccgacgtacgaggtcacgttcctgaaccagcttccaggggagctcacctgcggcggcgggaggtcgccggtcgaggtggccagctacgtccaggaggtcctggccgcgcagcttggattcgagtgcacctgatgaagcagcaagtgcaaaagtggcatggtgacggttgcgtggcgttcaaaggtggactagggaacacagagcatgcaaccaactgtcaattgccgtgtgttgagagtggtgatcagttcatggtttcacgtttgctgttgatgtctgtgataagaaccatatgtatctctacaactattaagagcgttgtgt

SEQ ID NO: 111 - DNA, 3202 bp, Brassica napus
ccgcaaagatccgaaccgaacctgaaccgaaatttagaaatacccgaatggggctgaaatctttaaacccgaaaacccgaaacccgattagatccgaaccgaacccgaatgggtacccgaatgcccacccctaacatcatctataaaataaatatattcatatataacatttcaaatttcgaaatattattatttttgtataatttgtattactaaagttttcaaaaatttctacaatttttttaaaaaataaatatctaatcgtaaaatcattagtttcttatatatctacaaattttataaatattgtttaggctaaatttttgataattatatagtttttattaattttatacaaattgatttaatatatattaaatctatattaaatattagtaaaaaaatagtaaaatatataatatttaataaatttatttttaaatataaattagatttaaaaaattccttgctgaaaaacacctagtagtatatcataaaggatgtttattgcgatgtgtaattttaaatctaatgggggacaaagtgagaatcagggttataattgttagaaaaggatagttaaaggataaaatcgtaaagaggtcatattgattggagtgataactaatagttgagcggttaaccactttgaatgagcgcatttaaaacagagaccccttccctctctttctttcccaaattgacaaaaagactcaagagagaaagaaagaaaatgtctccggcgaagaagaagagcacaagctttcctccgataagcgagtgtaaaagcggagagtatgattcgattgctgcggatcttgacgggactcttctcctctcgcgaagctccttcccttatttcatgctcgtcgccatagaagcaggcagtctcttccgtggattgatcctccttctatctctcccgatcgtcatcatcgcttacctcttcgtctccgaagctctcggcatccaaatcctcatctacatctccttcgccggcatcaaaatccgcgacatcgaactcgtctctcgcgccgttcttccacggttctacgcggcggatgtgaggaaggacagtttcgaggtgtttgataaatgcaagaggaaagtggtggtcactgcgaaccccatagtgatggttgagcctttcgtgaaggattacttgggaggagacaaagttttaggaacagagatcgaagtgaatcctaaaacgatgaaagccactgggtttgtgaagaagcctggtgttcttgttggcgatttgaaaagattagccatcttaaaggagtttggagacgaatcaccagatcttggccttggtgaccgcacctccgatcacgacttcatgtccatttgcaaggtgcgtattatctccttttccaagcttattttacgtttcttgaatcgtttaaacacccgatttaggtggcctagttaattaagttgagtgtctgatacttcaaaaacctttcgtaatcaaagaatttaagtactttaaataaatgcagtaggacctatattaatgccgcgttaagggttcacatgatctagctagtgggatagattatacaataatttgtccatccaccccccttttttttaacattaacagccttcacatgatccatttacgtccagatgatttatttactttgtatgtgtatgtctgcatggaaacaattagattaagtattcttctaatgtttttgaaaaactgatttagcatacaaaaaaaacttgtaatcatacgtatatgtgaattcaataaatgaatgtaataaaattcaacttacaaaaagtaggtagatagaatatgatagaagtagtagttttcataaatgctttaaacctatcaccaactaccatccccacgtaagttggatggtccatttaatgaccgatcccatatgtcaacattttttttctttttttttctcatataccctgaaactttcagtattttaccatatttcttactataatagtgaaacttttgaatcttttaaatgattggtaacgagttgcttattttaattgtaacaggaaggttacatggtgcatgagaccaaatcagccacaacagtccccatagagcgtctcaagaaccgcataatcttccacgacggccggctagtccaacgtccgacgcctttaaacgccttaatcatttacctttggcttcctttcggcttcatgctttccatcttccgcgtctacttcaaccttcctctacctgaacgcttcgttcgttacacttacgagatcctcggtattcacctcactatccgcggccaccgtccccctcctccttcccccggcactcccggaaacctctacgtccttaaccaccgtactgctcttgaccccatcatcatcgccattgctctcggccgtaagatctcatgcgtcacttatagtgtctctcgcctctcccggatgctctctcccatccctgccgtcgctctgacccgagaccgtgccgccgatgctgcccgcatgagaaaactcctagagaaaggtatttgtaacagcagtccttattactataggcagagtgactctgaatctttactagaaaattggtttgaaaaagataatataacaactacttcataaatatcagaaacagagtatctctcactttttggatacataactggtctcatttttatcacatttggtctagtctgaatatttaatcatattcatgcgtagaataagataactttcgtctatataaaagtagaaaagagagcatctctataagtgttttactatatttgcgacaggtgatttggtgatctgccctgaaggcacgacttgtagagaaccgtatctgctgcgattcagtgctctatttgcagagctaagcgaccggatcgtacctgtggccatgaactgtaagcaagggatgttcaatggaacgacagtcagaggtgtaaaattctgggatccttacttcttcttcatgaacccaagacctagctacgaggccactttcttggaccgtttgcctgaagaaatgacggtaaacggcggcggtaaaactccaatcgaggtggctaattacgttcagaaggtgattggtggagtattggggttcgagtgcactgaacttacaaggaaggataagtatcttttgcttggaggcaacgacgggaaggttgagtctatcaagaagacaaaggatgataaatccagc

SEQ ID NO: 112 - DNA, 1872 bp, Arabidopsis thaliana
caatataggtgcatttaaaacataacgttccctctcttgtcttcttatttttgctctctgttctttagaactgccattaacgagagtgagagagagagacacacacacagcgagtgaaaatgtctccggagaagaagagtcaaaacttccctccaataacggaatgcagagacggagagtacgattcgatagccgccgatcttgacgggactctgcttctctcaagaagctccttcccttacttcatgctcgtcgctgttgaagctggaagccttttacgtggactaatcctccttctctcgttaccattcgtcattatctcttacctattcgtatccgaatctcttggtatccagatcctcatcttcatctcattcgctggtctcaaaatccgcgatatcgaacttgtctctcgcgcagttcttccacggttttacgcggcggatgtgaggaaagacagttttgaggtgtttgataagtgtaagagaaaagtggtagtgacggcgaatccgattgtgatggtggaggcgtttgtgaaggattatcttggaggtgataaagttttgggaacagagattgaagttaaccctaaaaccaatagagccactggatttgtgaagaagcctggtgttcttgttggtgatcttaagaggttagccattttaaaagagtttggtaacgaatcacctgatctcggcctcggtgatcgaacctctgatcatgatttcatgtctctctgcaagaaaggttacatggttcatgcgaccaagtcagccacaacgattccaaaagaacgcttaaagaaccgcatagtcttccatgatgggcgtttagcgcaacgtccaactccgttaaacgccattatcacatacctatggcttccttttggtttcatcctctccatcattcgcgtctacttcaacctccctttacctgaaagatttgtccgttacacttacgagatgctcgggatccacttaaccattcgtggtcatcgtcctccacctccttcccctggaactcttggcaacctctatgtccttaaccaccgtaccgcgcttgatcccatcatcgttgctattgctcttggacgtaagatctgttgcgtcacttacagtgtctctcgtctctcccttatgctttctcctattcctgctgttgccctcacccgtgaccgtgccaccgatgctgccaacatgagaaaacttctcgagaaaggcgacttggtgatatgtccggaaggcacgacgtgtagagaagagtatctactgagatttagcgctctattcgcagagctaagcgaccggattgtgccagtagcgatgaactgtaaacaaggaatgttcaacgggaccacagttaggggtgtgaagttttgggacccttacttcttcttcatgaacccaagaccaagctatgaagccactttcttggatcgtttgcctgaagaaatgactgtcaacggtggtggcaagactcctatagaggtggctaattacgtccagaaagttatcggcgcggttttgggcttcgaatgcaccgaacttactcgcaaggataaatatcttttgcttggaggtaatgacggcaaggtggagtctatcaacaacaccaagaagtgaatatcttattcttgttataacttggcattgacttattgcaagtaaggttggatcatatacgaattttcatgtgtgtaattgcttgagctcttgtcatcattatggtacgttattgttatgtttattctattttgttcttaatgtcgaacgggtaactatatccttaaaaactattttgtgatcccgtttctatacggatgtgtatagagactttctatttaaagtgcaaaattttattggaggaagtaaa

SEQ ID NO: 113 - DNA, 1545 bp, Physcomitrella patens
atgcagcaactcgacccattgactagttttcactgcagtgaaagcttcgaaggagtggagacctgcagagtggaagggcgtgcgaaccagagcattgtttcagatttggacggaacgcttctgcggtcaagaagctcttttccctactttatgttgctcgctttcgaagcagggagcccactccggtctgtcgttcttctgcttatttctcccgtagtatggcttgtctacaacttcgtctccgaggcagctgggattaagatgctcattttcgtctcgctggcgggactcaaagtgtccgccgtcgagtcagtggcgcggggtgttctgcccaaattctacttggaagacatgcactccatcagctaccgagtcttcacctcctgcgggaagcgctacgtcgtgacggcgaatccaaggatcatagtggagccgtttctgaaagagtatcttgacgtagaagctgtaatgggcactgaactacaaatctcgagcgggggatatgtcaccggttttgtaacgggccccggtgtactcgttggtgctgtcaaagagcgagctgtgaagaaatactttggacccgaccctccggacgtcggcctaggagacaggcagagcgacttcttattcatggatctctgcaaggaatcttacattgtacacagcgacaaggatgtgcccgccgtgtcgaaggaagacttcttaaaacctcttatcttccacgacggtagactggtgtgccgtcctacgccgctgatgtcgcttatcgtcatgctatggtgtcctattggctttgtccttgccgttgttcggatgctcatcggcattgcgttgccaatgtggtgggcgcttcctcttgaggcaatgctcggcgtcaccgtccgtgtgaaaggaattcccccgacgtgccccctccgaaacaagaagcggggtgtgctcttcgtgtgctctcatcgcactcttcttgaccctattttcttgtccattgccgttcgaaggaaagtcactgcagtaacatacagcatcagtcggctctccgaagtgctgtccccaatccgcactgtgcgcctcacgagggacaggaacacggacgccaacaccatggcaagtctattggaggaaggtgaccttgtggtgtgccccgagggcaccacttgccgggagccttatctgttgcggttcagttccttgttcgctgagctgacggatcaaattgtccccgtgacgatgaatatcaaaattaccatgtttcatgggacgagcgctcgaggctggaaaggcatggaccccttcttcttcttcatgaacccttgccctaagtatgaggtaacatttctggaccaactcccgcatcagctgacatgcaatggcggaaagaccagccacgaggtggcgaactacattcagcgcgtgttagcgaactctcttggatttcagtgcaccaatctcacgcgcaaggacaagtatactgtattggccgggaacgatgggattgtgccggatcacactctgcggcagcgagctggcagaatgttcggcttgtag

SEQ ID NO: 114 - DNA, 1506 bp, Physcomitrella patens
atgaagagagatcccttcgataccatcgacaagtgcagtgacaaaggcagaagcaagcagacggttgtctcggatctcgacggaactcttcttcgcagccgaagctcgttcccctacttcatgctggtggcattcgaagctggaggagtggcccgggcctttgtgctcctcttgtgctctccgctgtgttggcttctgtaccattgcgtctcagaatccatcggcattcgcctcctgatctttgtcaccttcgcgggcctaaaaatcggcggtatcgaagccatcgcacgcggaacgttgccaaagttttacgcggaagacgtgcatccggacacatggcgaatcttttcttcgtttggggagcggtacatacttacggcgacgccgcggatcatggcggagaccttcgccaagacgtatctgggagtggacggtgtgttggggacggagctgcatttcacttctggcggcatcgcgactggtttgttgatgaacccaggggttctaaccgggagaaacaaagaaattgtgctgaggcaagaattccaaggcttgaaccttcctgacgtgggtctcggagaccgtccgtccgaccacaacttcatgtccatttgcaaagaaggatacatcgttccgccgagcaacacaatactggcagcgtcgaaagaaagtctaatgaacctgctggtgtttcacgacggccgcctgatccaaaggcccacagcaggcatagcgctcatcatactgctgtggtacccgattggcgctgtgttggccgtgcttcggatcctggctggcatccttcttcccttccacttgttgaaattggtatacaagtttcttggggttggggtggtggttcgtgggaccccacccccagagcccaaagacggccccggacgaggaggctacctgtacgtgtgctcgcataggacgctactagaccccgtgatggtgggcgtggcgttgaagcggcgcgtgacggccgtcacgtacagcataagccggctgtcggaggtgttgtccccaatcaaaacagtggcactgaagaggaatcgggagaaagacgcggcgaagatcaggtctctgctgcgagaaggagaccttgcgatctgccccgagggcaccacctgtcgggagccgtatctgctgcgattcagcgcgctgttcgcggagctgtcgaaccagttggtacctgtggcgatgaacacgcgcatgagcatgttccacggcaccaccgcgcaggggtggaaatgcttggaccctttctacttcttcatgaatcccaaccctatctatgaggttacgttcctcaacgaattaccggttgagcttacatgtgccggtgggaaatcttcgtatgaagttgcgaaccacatccaacaacttttgtcgcaaacgttgggctttgaatgcacaaattatacacgaaaagacaagtatggggtgctctgtggaaacgacggttcaattcctttaaagtctcaagactcctttggttcgtag

SEQ ID NO: 115 - DNA, 2100 bp, Physcomitrella patens
atggagacgcaagaacccgaccctgtcacaagctttcactgcagcgaaaactatgacgaggtggagaactgcagggtggagggtcgggcaaatcagagcattgtatcagatttggacggaacgcttcttcggtcgcgaagctccttcccctatttcatgctgctagccttcgaagccggtagtccattacggttcatcattcttcttcttgtctctcccatcgtttggttcgtctacaacttcatctctgaggtagtcggtattaagatgctaatattcatatcgcttgcggggctcaaagtgtcagccattgagtcagtggcgcgtggtgtactgccgaaatttttcttggaggacatgcactccatcagctacagagtgtttatttcctgcgagaaacgctacgtcgtcacagccaatccaaggataatagtggagccattccttaaggagtatttagatgtagacgctgtgatgggcaccgagcttcaaatttcgagtgggggatatgctaccggcttcgtcaccggccctggtgtcttagtggggacagcgaagcaacgagctgtgaagaaatattttgggtccgaccagccggaccttggcctaggggaccgaacgagcgacttcgcattcatggacctctgcaaagaggcttacatagtgcctagctataaggaggtgccgtccgtgacgaagaaagactacttgaagccgttgattttccatgacggaaggctggtgtgtcgtcctacgccgctgatggcgctggcggtgacactttggtgcccgattggcttcgtcttggccatcatccgaatgttcattggcataatgttaccaatgtggtgggctctccctctagaagccatgcttggcgtcacggtccgtataaagggaattcccccgacatgtccccttcggagcaagaaacgcggcgtgctgttcgtttgttcacatcgcactctcctggaccccattttcttgtctatagccgtgcgaaggaaagtcacggcagtgacgtacagcatcagtcggttgtcggaagtcctggctccgatccgaactgtacgtctcacgagagacaggaacacagatgcgagcactatggctagtctcttggacgagggtgacctcgtagtgtgtcctgagggcaccacttgccgcgagccttatcttctgcggttcagttccttgtttgcagaattgactgaccaaatcgtccccgtaaccatgaacatcaagatttcaatgtttcatgggacgagtgctcgaggctggaagggcatggatccgttctttttctttatgaacccccgccctaagtacgaggtaacattcttagatcaactcccgcatcagttgacttgcaatggcggaaaaactagccacgaggttgcgaattacatccagcgtgtgttggcgaactctctcggatttcaatgcaccaatcttacgcgcaaagataagtacagggtgttggcggggaacgatggaattgtaccagatcgaagtctgcggcagagggccagcagaatatttggtttgcagtgacattagggtttacttgtaacgccacatgtcaaatcgcagcatcggatggtcctgtacccaaataatttcctaggtggcggaggaccgatttttttcctcaaattgtgcggagttagggaaaaccttcggtccccagctatgacccacatgtgctgcgttgtctgcatccagcccgacctcaactgtgtcgagcttctgctgttgattgattgacaccgactagaaaccaaatagtacaattttaagaggataaacatcgtgttataatttggaaagttgaaccatacaattcctttctatcagttacagcgtttgactaactacagaaacaggaagacactgttggacattgctctatctgcggcggtaaaaaggacactggctgcttttcagagacgacatataacttcggcttatgactgagttcttgttgctcctcaaaccttgaactgtaggactgtagctagtgtctctgctgtctcgcctgtaagcagaagcattaggcgtttgtattgtgtattattcctaccattcattgaaggacat

SEQ ID NO: 116 - DNA, 1676 bp, Physcomitrella patens
atggaggtgacgaagttgaaagaggccgggaactacagcttcgcggaggtgaaatcgtgcagctcagggaatgatcgcaggagccagaccgtggtggcggacttggacggcaccctcattcgggggcggtccgctttcccgtatttcttcctggtggcgttcgaggccgggagttacttcagggcgctgctgctgtcgctcatggcgccgctcattgggtttctctactactttgtggacgaggcgtccgggattcacctcatgatctttctctcattcgcggggctgaagattaaggacattgagggtgtggcgcgcgctgtgcttaccaagttctacgccgatgaccttcaccctgagacttggcgggtgttctcgagctttggcaagcgtgtggtgctgacggcaaacccgcgcgtgatggtggagccgtttctgaaggaggtcctcggcgcggacgaggttatggggacggagattgaggtgaacaaaaagggccgcgctacaggcaggcttctgaagccgggtgttctggttgggacacacaaggaggaagctctaaagcggtgtaacattggaggtgagcgcccgcacgtcgggctaggcgaccgcgttacggatttccctttcatggcgtactgcaaggaaggctatgtagtacccaaaacgaaagtgccagccgttaagaagcaagacatgccgaagcagctaatctttcatgacggtcggcttgtgcaactcccaacgccccgtaatgctttcaaagtgctggcatggatgcctatcggcctgcttttgtccatcgtccgcgtcacgatgggtgtatgggtccccatacgcttgatgccactgtgttacaaactcacaggcatcaacctcgttgttaagggaaacatccctgagaagcccaagaatggagaacccgggagactcttcgtctgcaaccaccggactcttctggaccccgtcatcatcgctctggcgcttgggcgccccgtccctgccgtgacttactccatatccaaagtctcagagttcctgtcccccatgccaacaatcggcctgtgccgagatagggagaaagactcggccaatatgagaagggtgctgaaagagggtgagctcactctttgtcctgagggcactacttgcagggagcctttcttgcttcgattctcagctctcttcgccgagttgagtgacaggattgttcctgtggccgtaaaaattaacatgaatatgtttcacggcacaactgctcgcggtaacaaagccatggaccccttctttgcttacatgaaccctcggccgaccatcgaactcaaattcctagacgagattccaaagaacatgacatgtggtagcggaaaatcgtccattgaagtggcgaactacatacaacatctccttgccggagaactcggatatgattgcacagatttcactcgcaaggataagtaccggttgctcgcaggaaacgatggcattgtacctgttaaggagaaaacgaggtaatgaatcgacctgcaagcacattaccacagaacaagacattgaaagtgcttacgattcagtatcactagatggaggggttaaccccgactcagtactataagtgtagaattcagtgccaaaggcaataaactgtgattgattgttacataaactcgatgcaa

SEQ ID NO: 117 - DNA, 1590 bp, Physcomitrella patens
atggaaattccaggagtgtttgatgctaatctcttctgcgctgagtcatttcctgaagtcgaaacttgtaaagtggaaggtcgtgaaaaacagacgattatttcagacttagatgggacgctcctcagatcaagaagctcgttcccttacttcatgctcattgcgttcgacgctggaagccctctccgcttcatcgtcctcttgctggcctctccaataatttggctggtctacaacttcttctccgaggctgccggtaccaaactgctcattttcattgcatgtgctggcttgaaagcgtccgacatcgagtctgtagcgcgcggcgtgttgcccaaattttacttggaagacatgcactccgtcagctacagcatcttcgtctcctgcggtaagcggtatgtggtgactgcgaatccgcgcatcatggtagagtcatttctgaaagagtacatgggcgtcgaggcagtcataggtactgagcttcatatcacgaagagcggttacgccacgggtttggtaatgggtgccggtgtgattgtgggagctaacaaaacgcgcgctgtgaagaaatactttggcgatgaccttccagacatcgctctcggagaccgagccagcgactttccttttatggctctttgcaaggaggcatacttagtaccgagcttcaagcctgtcgagccagttgccaaagctgactacctgaagccgctcattttccatgacggcagattagtatgtcgaccaacacctctcatgtcactcgtaattattctctggtcgccgatcggtcttattctagcactcattcggatggtgtttggcaccgtgttacccatgtggtatgcgctgccgctggaggccatgcttggcgttagcatccgcgtgaaaggaatcccccccagctgcccccaaaccagcggcagacgcggtgtgctcttcgtctgctctcaccgcactttgctcgaccccatcttcctgtcaatagcctgtcggcgacaagttacagcagtaacctacagcatcagcaaggtctcggagatactgtcgccgatccccacagtccgactcacaaggtgtcggaaaaccgatgcggagaccatgacaaagcttctcaacgagggagatcttgcagtgtgcccagaaggcacgacgtgccgcgagccataccttcttcggttcagctccttgttcgcggagttagccgaccaaatcattcccgtcacgatgaacgtcaaaacgaccatgttccacggcacgacagcccggggctggaaggcactggacccctttatctttctgatgaatcccagccctaggtatgaattggagtttctagatcagcttccgcacgagatgacctgcagcggcgggaagagtagtcacgaggttgcgaactacattcaacgagtcctcgcggcatctctgggtttcaagtgcacgaacctgacgcggcgagacaagtatcgaatcttagcagggaacgatggcgtggttcctgcaagccattttttgaaacaaagaagcaggatcttcgcatgcttgccttccaggaatagtgagagaggccagcgatcagacccgtaa

SEQ ID NO: 118 - DNA, 1512 bp, Vitis vinifera
atggctgtaactacctttccaactgtggaccagtgtcaatccattggccgagaaaagcacactgtggttgcggacatggatggaaccttgcttattggcaggagctcctttccttactttgctttggtggcttttgaggggggaggtgttctaaggctgctcttcctgctcttggcttcaccactcgctggacttctttactattttgtgtcggagtctgcaggaatccagattctcatctttgtaaccttcgctgggatgaaggtgtcagacattgagtcagttgcacgtgctgtgctgcccaaattttatttgagcgatctccatcccgagtcatggcgggtgttctcatcatgtggaaagcgttgtgttcttaccgcaaaccccaggataatggttgaggcatttctgaaagattttttgggagctgatttagttttggggactgagatagccacttataagggtagggcaactgggtttgtttgtgatccaggtgtacttgtgggcaagaacaaggcatatgctctcaacaagacttttggagagacccagcctgagattgggctgggtgatcgtcacactgattttcccttcatggcttcatgcaaggagggctatattgtggcagccaaaccagaggttaaggcggtaacaagtgacaagcttcccaagcccatcatcttccacgacagccgcctcgtccaaaagccaactcctctcacggcactcctcacccttctctggatccccataggcttcgcactcgcatgcttgcgaatcgccgctggctcactcctccccatgcgcattgtctaccacgctttctgggcactgggtgtccgagtctccgtcaagggttccccacctcctgttgccaaaaagtcaataggccagtcaggcgtgctattcatctgctcccaccgaaccctccttgacccaatattcctctccgcagcgctcggccgtcccattcctgcagtcacgtactccgtctcccgcctctccgagttcatctcccctatcaaaaccattcgcctaagccgagatcgagtcaaagacgcagccatgataaagaaactgcttgaagaaggtgacctagctatttgccccgaaggaaccacttgccgtgagcctttccttctcaggttctcagcattgtttgctgaactgactgaccagcttgttccagtggctatgatgaaccgcatgagcatgttccatggaacaacagcaagagggtggaaagggatggacccatttttcttcttcatgaatccaagcccagcgtatgaggtaacgttcttgaacaagctgcccctggaacttacttgcagttcggggaaatctagccatgaggtggccaactacatgcagagggtgattgctgccactctttcctatgaatgcactagctttaccaggaaagataagtaccgagcactcgctggaaatgatgggaccgtgcccaaaaaacctctgctatatcccgacaaagtcatgggatgctga

SEQ ID NO: 119 - DNA, 1784 bp, Vitis vinifera
gtttcttttcgttgtccactgtgctgcctgaaaggctgaatccggttctaccggccgagacatgtctccgccaccgaaacgcgcccgaaaatttccctccatcactacctacgccggcggcgaccatcgctctattgcggccgacctcgatggcactctcctcgtctctcgctcctccttcccttacttcatgcttgtcgccgtcgaagccggcagcctcctacgcggtctcttccttctgctctctcttcctatagtgatcgttgcctacctcttcatctcagaagaaatcggaattcagattctcatcttcatttcattttccggcctcaagatccgagacatcgagctcgcgtcgcaggcggtgctgccgcggttctacgccaacgacgtgaggcgagagagctgggaggtgttcgagaagtgcgaacggaaggtggtggtgacggccaacccgacgttgatggttgagccgttcgtgagagattttcttggcggaacgaaggtgttagggacggagattgaggtgaatccgaagacgaagaaggccactggtttcgtgaagaagccaggggtgttggttggagacagaaagagattggcgctgttgaaggagtttggtgatgaattgcctgatatcgggattggtgaccgcgagtctgatcatgatttcatgtccatttgcaaggagggatacatggtgcttccgagtaaatcagctacgccggtgccacccaaccgcctgaaaaccccaataatattccacgatggtcggttcgtccaaccccccacgccactcacggccctcatcatctacctctggcttccatttgggtttgcactctctatcttccgagtctacttcaacctccccctcccagagcgcatcgtccgctacacctacccgatgctgggcatcaaccttgttatccgaggcaaccctcctccgcccccctccccaggttcccccggcaacctctacgtctgcaaccaccgcaccgccttggaccccatcgtcatcgccatcgccctccgccgcaaggtctcctgcgtcacctacagcgtcagccgcctctctcgcttcctctcccccatccccgccgtcgccctcacccgcgaccgcgccgccgacgctgcccgcatctcctccattctccagaagggcgacctcgtggtctgcccagaggggaccacctgccgcgagccctacctcctccggtttagcgcactgttcgcggaactcagcgaccgcatcgtgccggtggcggtgaacgtgaagcagaacatgttccacggcaccaccgtccgaggggtgaagttctgggacgcctatttttacttcatgaaccctcggcccacctatgagataacgtttctggatcggttgccggaggagatgacgtgtaaggccggagggaagtcggccatagaagtggcgaatcacgtgcaaaaggtgttgggtggagtgctggggtttgagtgcactggactgactagaaaggataagtacatgttgctgggaggaaatgatggcaaggtggaatccatgtacaatgccaagaagtgaaaggctgggatcggagaagaaggccacattggaattgtatgggttttagaaaaattacgagggaggtatatcggttaatgtagaattacaacttctatggaaattcccttagtatgattgataattgttgatcatttttcatctggattattcatattatttggacattcaagtttagagttatgaagagtgtcttctgatttctgtggttgatttt

SEQ ID NO: 120 - DNA, 1533 bp, Vitis vinifera
atgaccaaatcaaacctccactctcctcccacctccctaaccatcgatcaatgcacctccatcggccgggaaaaggagacggttgtggcggacatggacggaactcttctcagagggcgcagttcgttcccctactttgcacttgttgccttcgaggttggtgggatttttaggcttcttctgttgttgctatgttctccattggctggagttctctactacttcatatcggagccagctggcattcaggtgctcatattcgcgacctttgtggggatgaaggtttcggatatcgagtcggtggcgcgggcagttttgcccaagttttacgcgagcgacctgcacccggaggcgtggagggtgttctcgtcgtgtgggaagaggtgtgtgctcaccgcgaatccgaggattatggtggaggccttcctgaaggattttttgggtgcagacatggtgttggggacggaggtggacacgtataaagggagagctactgggcttgtccgtggtggtggggttcttgttgggaagagaaaggcagaggccctccgaaatgccttcagcgagacgtctttaccggagattggactcggtgatcgggagacggattatccatttatgagtctctgcaaggagagttacatagttccagcgaagcctgaggtggaggctgttagccatgacaaattgccaaagcccattgtattccacgacggccgcctcgtccaaaaaccaacccctttcatggcgcttctcaccatcctctggatcccagtaggcttcctcttggcctgcttgcgcatcgccgctggtgcgctccttccaatgccgcttgtctactacgccttttgggcactcggtgtcagagtttatatcaagggcaacccccctccaccagccaaaaaatcaataggccaatctggcgtcctcttcatttgctctcacagaaccctcctcgaccctatcttcctctccgccgcattaggccgccctatccctgcagtcacgtactccctttctcgtctctccgaattcatctcccccatcaagacagtccggctcagtcgcgatcgagccaccgacgcagcaatgataaagaagctcttagaggcaggtgacctagccatatgtcccgaaggaaccacttgcagggagccatttctgctaagattttctgccttgttttctgagctaaccgacgagctggtgccggtggctatggcaaaccgcatgaccatgtttcatgggacaacagctagaggttggaaggggatggaccccttttactacttcatgaaccctagccctgcctatgaggtaaacttcttgaataagcttccacatgagctcacttgcggtgctggaaaatcgagccacgacgtcgcgaactacatacagaggatgattgccgcaagtctatcatatgagtgcaccaacttcactaggaaggataagtatcgggcactggccgggaacgatggaactgtagtggaaaagcccaaggttgatgctaataaagtcatgggctgctag

SEQ ID NO: 121 - DNA, 1726 bp, Vitis vinifera
atgggggctcaacgccatttccaaccaatatcgaaatgcagctccgacggtcgagccaatcagacagtggcggcagacttagatggcacgcttcttgtgtcccgaagcgcatttccctacttcatgcttgtggcacttgaagctggtagccttgtgagggcaatcctcctcctagcatcggttccactagtgtatttcatttacttgttcatttcggagtcgctagccattaaaatctttatctatatggcttttgcgggactcaaagttagagagattgagcttgtttcgaggtcagtcctgcccaagttctatgctgaggatgtgcaccccgagagttggagagtgtttaattcctttgggaagaggtatatcattactgccaatcctagaattatggtggaaccctttgtgaagacctatatgggtgccgataaggttcttgggaccgagttggaagtatcgaactccggaagggcgactgggtttgtgaagaaaccaggagttttggttggggaacataagaaagcggcagtgcagcaagaatttggcatgaatttgccagatgtgggcctgggagatagagatacggatcatgatttcatgtccttatgcaaggaaggatacatggtgccaaggacaaaatgtgagccactaccaaggaacaagcttctgagtccagtcatttttcacgagggacgtttggttcagagacccacccctgtggctgccctgttgactttcttatggatgccaattgggatcattctctccatccttagggtctacctcaacattcccttgccagagcgtattgtgaggtacaattacaagatcctgggaatcaagcttattgttaagggtacacctcctcccccgccaaagggaggccaaagtggagtcctcttcgtttgcaaccataggacagttttggaccccgtggtcacggctgtggctttaggcagaaaaatcagctgtgtcacttacagtattagcaaattctcggagctaatttctccaatcaaagccgttgcactatccagggagagagaaaaggatgcagcaaatatcaagcgcttacttgaagaaggtgatttagtaatttgtccggagggaactacatgtagagagccatttctgttgagatttagcgccctttttgctgagctcactgatagaattgtgcctgttgccattaataccaagcagagcgtgttttatggcacgtcaacccggggttataagttgttggatccttacttcgtgttcatgaatccaatgcccacctacgagatcaccttcttgaatcagctgcccgccgagctcacttgcaaaggtgggaaatccccaatcgaagttgcaaattacatccagagggtgctggctggaacccttggctttgagtgcactaacttgaccaggaaggacaaatacgccacacttgccggaacagacggcagtgttccgttcaagaacgaaaaggaaaaggaaaaggcttgagaactgaaagtgattcaaagtaaattaattagtctcatgattttctattgttttacatatattatatgccggaatcattatcatgacaatgaactccgattgtgatgataataaattgttgtgattataaaaataatagtttcttatattgtcgtggagacaagtcaacggtcattttttttaagtttttgaaaataaattttatctggacaagtttcaccttaga

SEQ ID NO: 122 - DNA, 1504 bp, Populus trichocarpa
tcctctctcatggtaatgggggctcatcgccattttgaaccaatagcaaaatgtagcacagagggacgatcaaatcagactgtggctgccgacctggatggaacacttcttgtatcaagaagtgcttttccatacttcttgcttgttgctattgaagctgggagtctcttaagaggactaattctcttagcatcagtcccatttgtatactttacgtacttatttatatcagaggcaatggcaatcaagactttcatcttcattgcctttgcgggacttaaaataagagacattgagcttgtttcaaggtctgtcttgccaaagttttatgctgatgatgttcatccagaaacttggagggtgttcaattcttttggaaaaagatacattgttactgctaatcctaggattatggtcgagccatttgtcaagacctttttaggggctgacaaggttcttggcactgaattagaggctacaaaatctggaagagcaactgggtttatcaagaaacctggagttcttgttggagatcataaaagagatgctctcttaaaagagtttggcacaaatttgcctgatttaggcctgggagaccgcgaaactgaccatgacttcatgtccatttgcaaggaaggatatatggtgccaggaaccaagtgtgagcctctagcaagaaacaagcttctaagccctgtcatattccacgatggccggttagttcaaaggcctactcctttggctgcccttttgaccttcttatggatgccaattggtattattctctccatacttagagtctaccttaacatccctttgcccgagagacttgcctggtacacttataagctactaggaattagagttattgtcaagggtacccctccaccccctccaggaaaaggccacagtggagtcctctttgtttgcaatcatcgtactgtcttagacccagttgtcactgctgttgcactaggaagaaaaattagttgtgtcacctatagcataagcaagttcactgaaattatttcacccattaaagctgttgctttatcaagggagagagacaaagatgctgctaacattaagcgactgcttgaagaaggtgacctggtcatttgccctgaaggaaccacatgtagagagccatttctcttgagatttagtgctctttttgctgagcttactgataggattgtgccagttgctatcaatacaaaacaaagtgtgtttcatggcacgacggttcgagggcacaaactgttggacccttattttgtgttcatgaatccaatgccaacatatgaggtcaccttcttgaatcagctgcccaaagagcttacttgcaaaggaggcaaatcagccattgaagttgcaaattacatacaaagggtgctggctgggacacttggatttgagtgcactaacttgaccaggaaggacaagtatgctaagcttgcaggaacagacggccgtgttctatctaagaaggaaaatgcttgag

SEQ ID NO: 123 - DNA, 1506 bp, Populus trichocarpa
atggttagcttcccaactgttgacaaatgtgcatccatcggcagagaaaagcacagtgtagttgctgacatggatgggaccttgcttagaggccgtagctcattcccttactttgctctacttgccttcgaagctggtgggatttttaggctgcttttcttgctcttgaactcaccactagcaggacttctgtattactttgtgtccgagtctgctggtattaaagttcttatctttgctacatgtgccggaatgaagttatcagatatcgagtctgtagcacgtgctgtgctgccaaagttttactctagtgaccttcattctgagtcgtggcgtgtgttctcttcttgcggaaaacgttgcgttcttactgcaaatccaagaattatggtggaagcatttttgaaagatttcttgggagctgatttggttttggggactgagatattaacttataaaggtagagcaacagggtttgttcagagcccgggagtacttgtggggaagaacaaggcagatgcccttaaaaaggcttttgggaagacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcataattctctggatccctataggcttcattttagcctgcttgaggattgcagcagggtcactcctgcctatgccaatggtctactatgctttctgggcacttggtgtccgtgtcaacataaagggaaccccacctcccccagccaaaaaatcaattggtcaatctggtgtcctctttgtttgctcacacagaaccttgcttgatcccatatttctctccactgcccttgggcgccctattccagcagttacatactcactttctcgtctctctgaaattatctcaccaatcaaaactgttagactcagccgtgaccgagctgcagacgcatcaatgatcaagaagttattagaagaaggtgacctagctatatgtcccgagcgaactacttgccgcgaaccgtttcttttaaggttctcggctttgtttgctgaattaacagacgaactcgttccagtggctatggcgaatcgcatgagtatgtttcacggaaccactgcaagaggctggaaagggatggatccattttacttcttcatgaaccctagcccagcatatgaagtaactttcctgaacaagttgccactagagctaacattaagtggtgggaaatctagccatgaggtggcaaactacatacaaagagtgattgctgctactctctcctatgaatgcacttcctttactaggagagacaagtacagggcacttgctgggaatgatgggaatgtggttgaaaagacgaaggtccaagccaacaaagtaatggggtgttaa

SEQ ID NO: 124 - DNA, 1506 bp, Populus trichocarpa
atggatagctttccaactgttgacaaatgtgcatccataggtagagaaaagcacactgtggtagctgacatggatggaaccctgcttagaggtcgtagctcattcccttactttgctctacttgcctttgaagctggtgggatttttaggctgattttcttgctattggcctcaccgctagcaggacttctatactactttgtgtccgagtctgctggtattaaggttcttatatttgctacatgtgccggaatgaaggtttccgatattgagtctgtggctcgtgctgtactgcctaagttttactctagcgatcttcattctgagtcgtggcgtgtgttttcttcttgtggaaaacgatgtgttcttactgcaaatccaagaattatggtggaagcatttttgaaagatttcttgggagctgatttggttttggggacagagatgtctacttataaaggtagagcaacagggtttgttcagagcccgggagtacttgtggggaagaacaaggcagatgcccttaaaaaggcttttgggatgacacaaccagagattggacttggagatcgtcatacagatgcacccttcatggctctatgcaaggagggctacatagtgccacctaagccagaggttgaagctgtaactactgacaagctcccaaaaccagtcatcttccatgatggccggctagtccaaaaaccaacaccattatcagcactactcacaattctctggatcccaataggcttcattttagcctgcttgagaattgcagccgggtcactcctgcctatgccaatggtctactatgctttctgggcacttggtgtccgtgtcatcataaagggaaccccacctcccccggccaagaaatcaatcggtcaatctggtgtcctctttatttgctctcaccgaaccttgcttgatccaatatttctctccactgccctcggccgtcctatcccagcagtcacgtactcagtttctcgtctctctgaaattatctcacccatcaaaactgttagactcagccgtgaccgtgctacagacgcatccatgatcaagaagttgttagaagaaggtgacctagctatatgccctgagggaactacttgccgcgaaccctttcttttaaggttctcagctttgtttgctgaattaacagaccaacttgttccagtggctgtggtgaatcgcatgagtatgtttcatgggacaacagcaagagggtggaaagggatggatccgttttacttcttcatgaaccctagcccagcatatgaagtaactttcttgaacaggttaccacaggagctaacctgcactggtgggaaatctagtcatgaggtggcaaactacatacaaagagtgattgctgccaccctgtcctatgaatgcacttcctttactaggagagataagtacagggcacttgctgggaacgatggtactgtggttgaaaaaacgaagctccaagccaacaaagtaatggggtgttga

SEQ ID NO: 125 - DNA, 1797 bp, Populus trichocarpa
acaacataactcacacttcctaagaactctcaaaataaacactatctatccctctccctctccctctctatccccctctgtgatggtcatgggggctcatcgccattttgaaccaatagcaaaatgtagcacagaggggcgatcgaatcagaccgtggctgcagacctagatggaacacttcttgtatcaagaagtgcttttccttacttcttgcttgttgctattgaagctgggagtctcctgagaggactaattcttttatcatcagtcccatttgtgtactttacgtacttaattatatcagaggaaatggcaatcaagaccttcatcttcattgccttcgctggacttaaaataagagacattgagcttgtttcaaggtctgtcttgccaaagttttatgctgatgatgtccatccagaaacttggagggtgttcaattcttttggaaagagatacattgttacagcaaatcctaggattatggtagagccatttgccaagaactttttaggtgctgacaaggttcttggcactgaaatacaggctacaaaatctggaagggcaactgggtttgtgaagaaacctggagttcttgttggagatcataagaggaatgctctcttaaaggagtttggtacaagtttgcctgatttaggcctgggagaccgcgaaactgaccatgacttcatgtccatctgcaaggaaggatatattgtgccaagatccaagtgcgagccactaccaagaaacaagcttctaagccctgtcatattccatgagggccggctggttcaaagacctactcccttggttgcccttctgacgttcttatggatgccaattggtattattctctccgtccttagggtctaccttaacatccctttgcctgagagaattgcctggtacaattataagctgctaggaattagagtagttgttaagggtaatcctccaccccctccaagaaaaggccaaagtggagtcctctttgtttgcaatcaccgtactgtcttagaccctgttgtcactgctgtcgccctaagaagaaaaattagctgtgtcacatacagcataagcaagttcactgagattatttcacctatcaaggctgttgctttatcaagggagagagacagagatgctgcaaatataaagcgtctacttgaagaaggtgacttggtaatttgcccggaaggaaccacttgtagagagccatttctcttgagatttagtgctctttttgcagaacttacagataggattgtgccagtcgctatcaatacaaaacaatctgtcttcaatggcacgacggttcgagggcacaaactgttggacccttattttgtgttcatgaatccaatgccaacatatgagatcaccttcttgaatcagctgcccacagagcttacttgcaaaggaggcaaatcatccattgaagttgcaaattacatacaaagggtgctggctgggacacttggatttgagtgcactaatttgactaggaaggacaagtacgctatccttgcaggaacagacggccgtgttgcaactaagaaggaaaaggcttcagaaaattaatctctccaaaaggcggcataaaagaaaatccatgatttaatttctctattgtttttttttatatataaaatattgctataacaataaaatttgacaatcgctattgtgattaattactataaaataactttagagtatatttgctttttttattttttaagtatgtataccgacatcaaattactctaatgcaatgtttatttaatcttcaa

SEQ ID NO: 126 - DNA, 1575 bp, Sorghum bicolor
atggagcgtcccagcccaacgtgcttagcggcgaacggcccacgtagaaaagcccgaacaatcccgttcccgccgcccccggctgatcttcgtacggggaggttgcggtcgcggcagacggtcgccgccgacctcgacggcacgctgctcctgtcccgaagcgcgttcccgtactacctcctcgtggcgctggaggccggcagcctcctccgcgccgtggcgcttctcatgtccgtgcccttcgtgtacctcacctacgtcaccgtgtccgagaccctggccgtgcgcgcgttcctctacgtcgccgtggcggggctcgacgtgagcgacatcgaggccgtcgcccggaccgtgctccccaggttctacgccggcgacgtccacccggagggctggcgcgtcttccgctcgttcgggaggaggtgcgtcgtcaccgccagcccgcgggtgatggtggagccgttcgccagggcgttccttggcgccgacgtggtcatcgggacggagatggaggtgggcgcgtccgggaaggccacggggttcgtcgccgggcccggggtgctcgtcggcgaacacaagaggcgggcggtggtgagggagttcggcgacgcgctgccggacgtcggcatgggggatcgcgagagcgacttcgacttcatggccatctgcaaggaagcgtacatggtaacacggcagaagtaccgcgcgttgccccgggagcagctgcagagccgggtcatcctccacgacggccgcctggcccggcgaccgacggcgaccaacacgcttctcactctcctgtggatgccgctcggcttcgcgctcgcgctggcgcgcgtgcatctccacctgctcctcccggcgcgcgccctctcctacgcctacaagcttatgggcgtcaagctggtggtgcgcggcaaccggccgccgccgccgccgccgtccaagaagggcggcggccccggggttctcttcgtgtgcaaccaccgcaccacgctcgaccctgtcgcggtggccgtcgcgctgggccgcaaggtgagatgggtcgtcacggacggcgcctccagcaggttctcggaggccgtgtcgcctgtcatgacaggcgtggcgctgcccgtgcccgtgcccagccgcgagagcgacgacgacgcggacgccgccgcccgcatccggcggctgctcgaggagggagacgacgtcgtcatcttccccgagggcaccatctgccgcgagcccttcctgctgcggttcggcgcgctcttcgctgaggtcaccgaccgcatcgtgcccgtggccatcggcgctagggagggcatgttccacgggtccacggcgcgcgggctcaggagaatggatccctacttctttttcatgaacccacggccgacgtacgaggtgacgttcctgaaccagcttccaagggagctcacctgcggcggcggaaggtcgccggtcgaggtggccaactatgtccaggaggtcctggccgcgcagcttggattcgactgcacttgcaccagcaagcaggcaaaaacaggatggtctccggcggccccgacggttgcgtggcgttga

SEQ ID NO: 127 - DNA, 1967 bp, Sorghum bicolor
gcctcccatatccatactcccccgcgcccgtcaccaccaacctcccgtcgcgtatattataactacacctcgccgccccactctccactgccaactcgcagcagcagtctctcctctgctcccacacactccttccccggggcctggcagtgagatcgagcctcgatccatcgagcactatagtagcaaagacacaagatggtggcgtcgtatcgcagtcgcaggttcaagcccatcgaggagtgctgctcggaggggcggtcggagcagacggtggccgccgacctggacggcacgctgctcatctcccggagcgcgttcccctactacctcctcgtggcgctcgaggccgggagcgtcctccgcgccgtgctgctgctcctgtccgtgcctttcgtctacgtcacctacatcttcttctccgagtcgctggccatcagcacgctcgtctacatctccgtcgcggggctcaaggtgcgcagcatcgagatggtggcgcgctccgtgctccccaggttctacgctggcgacgtgcacccggagagctggagggtgttcaactccttcggcaagcgctacatcatcaccgccagccccaggatcatggtcgagcccttcgccagggccttcctcggcgccgacaaggtcgtcgggaccgagctcgaggtcggcaagaacggcaaggccacggggttcatggtcaagcccggcgtgctcgtcggcgaccacaagaagaaggccgtcgtcaaggagctgggcgacgccgtgcccgacgtcggcatgggggatagggagaccgacttcgacttcatgtccatctgcaaggaggcgtacctggtgacgtcgaggaagtacagcccggtgggcaagaaccagctgctgagcccgctgatcctacacgacggtcgcctggtgcagcgcccgacgccgctcgtcgcgctcgtcaccttcctctggatgccgttcggcttcgcgctcgcgctcatgcgcgtgtacatcaacctgccgctgcccgagcgcatcgtctactacacctacaagctcatgggcatcaggctgatcgtcaagggcaacccgccgccgccgcccaagaagggccacccgggcgtcctcttcgtctgcaaccaccgcaccgtgctcgaccccgtcgaggtcgccgtggcgctgcgccgcaaggtcagctgcgtgacctacagcatctccaagttctccgagctcatctcgcccatcaaggccgtcgcgctgtcgcgggagcgagagaaggacgccgagaacatccgccgcctgctggaggaaggcgacctggtgatctgccccgagggcaccacctgccgcgagcccttcctgctgcggttcagcgcgctcttcgccgagctcaccgaccgcatcgtgccggtggcgatcaacaccaaggagagcatgttccacggctccaccgtgcgcgggttcaagctcatggacccttacttcttcttcatgaacccgcggccgacgtacgagatcacgttcctgacccagctccccaaggacctcacatgcagcggcggcaagtcgcccatcgaggtggccaactacatccagaagacgctcagcggacagcttggcttcgagtgcaccaccatcacgcgcaaggagaagtacggcatactcgctggaacggacggccgtgtcccgtccaagaacaaggacaaggagaaggagaagaactaacggccaacgtcgtcatcgctgctgcccgcccagcacactgccgttacgagtactgctgaaatttattccaattaattgttccttgtcgagaagttggccaattactcattgtttttaaaaggaccatgtgatgtgggccgtgtactagtacaagcttgatgatcatataattattatctacaagttcttcctcttcggaagaagggcaaaagtgttgttaggcccgtcttaatacaaagtttcgttgcatagtttcc

SEQ ID NO: 128 - DNA, 1518 bp, Sorghum bicolor
atggctgcctcgccgttccccacggtggagaagtgctcctccaccgaccggtccggcgacacggtggtggcggacctggacggcacgctgctgtgcggccggagctccttcccgtacttcgcgcacatggcgttcgagaccggcggcgtgctgcgcctgctgctgctcatcgcgctggcgccgctcgcgggcctcctctactacttcgtgtccgagccggcgggcatccaggtgctcatcttcgcgtccatggcgggggccagggtggccgacatcgaggccgtggcgcgggcggtgctgcccaagttctactgcgccgacctccacccggagtcgtggcgcgtcttctcggcgtgcggccgccggtgcgtgctcaccgcgaacccgcggatcatggtggaggcgttcctcaaggagtacgtcggcacggacgtcgtcgtcggcacggagctcgtcgtgtggcgaggccgcgcgacggggctggtgcgctccccgggcgtcctggtcggcgagcagaaggcggacgcgctccggaggacgttcggcgacgacgtcgcgcccgaggtcggcctcggcgacaggaagacggactacccgttcatgaggctgtgcaaggagggctacgtcgtgccggcgacgcccaagctgaagcccgtgccgcgcgagaacctgccgaagccggtggtcttccacgacgggcggctcgtccagaagccgtccccggcgctcgcgctgctcaccgtgctctggatcccgatcgggttcctgctcgcgtgcctgcgcatcgccgcgggcgcgctcctgccgatgcgcatggtgtaccacgcgttccgcgccctcggcgtccgtgtcaccatcaggggaaaccctccgccgccggcaagccgcgagacgggccagaccggcgtgctcttcatctgctcccaccgcaccctcctcgaccccatcttcctctccaccgccctgggccgccccatcaccgccgtcacctactcggtctcgcggctgtcggaaattctgtcgccaatccgcacggtgcgcctgacccgagaccgcgcggcggacgcggccatgatccggcggctcctgaccgagggagacctggtgatctgcccggaggggacgacgtgccgggagccgttcctgctgcgtttctcggcgctgttcgcggagctgacggacgagatcgtgccggtggcgatggagaaccagatgagcatgttccacgggacgacggcgcgagggtggaaagggctggaccctttctacttcttcatgaacccgagccccgggtacgtggtcacgttcctcaacaagctcccagcagagctcacctgcaatggcggcggcaagagcagccacgaggtggccaactacatccagcggctcatcgcgtccacgctgtcctacgagtgcaccaacttcacacggaaggacaagtacaaggcgctcgctggcaacgacggcaccgtcgtgtccaagcccaacattgacaagaacaaggtcatgggctgctag

SEQ ID NO: 129 - DNA, 1776 bp, Sorghum bicolor
gcagtgcgcagtgcgagagagagacagagtgagtgacagctccgatccgccgcacacgcgcgtgccacagcagatagcagcgagccatccatcccggcggccggcatggaggaggcggtggaggctgtggttgccgccggagtggagccgttcccgacggtggacaagtgcgacgcctcgggcctcggcgcgcactcctccgtggtggcggaccttgacggcacgctgctccggtcccgcagcgcgttcccgtactacgcgctggtggccttcgagaccggcggcgtgccacgcctgctcctcctcctgctcctctccccgctggccgccttgctgcgcttcctggcgtcggagtccgcgtgcctgcgcgtgctggtgttcggtgccacggcgggcgcccgtgtccgcgacgtcgagtccgcggcgcgcgccgtgctccccaggttctacgccgccgacgtgcacccggcggcctggcgcgtcttctccgcgtgctcccggaggcgcgtcgtgctcacggccacgcccaggctcttcgccgagccgttcctcagggactgcctcggcgccgacgccgtcgcgggcaccgagctcgccacgtggcgcggacgcgccacgggcttggtggacgcgcgcaggggcggcgtcctcgtcggcaggagcaaggcccaggcgctgcgggagatcttggccgccgacggcggcgacgcgcccgacgtcggactcggggacagccgctccgactaccccttcatgagcatgtgcaaggaggcgtacatcgtaccgcgcgcgccggtggagccggcattgcccatggaccagctgcctcgtccggtcatcttccacgacgggcgcctggtgcgccggccgacgccgctggtggcgctggtggtggtgctgtggttccccgtggggcttgcgctggcctgcctccgcatcgcggcgggggcgctgctgcccatgccgctggtgtactacgccttctgggcgctgggcgtgcgcgtcgtggtgcggggcgcgccgccgccgccgcgcgccgagcgcgccacggggcggaggggcgtcctcttcgcctgctcgcaccggacgctgctggaccccatcttcctgtccacggcgctgggccgccccgtcgccgccgtcacctactcgctctccaggctctccgagttcctgtcgcccatccggacggtgcgcctgtcgcgggaccgcgccacggacgccgccatgatcagggacctgctggcggagggagacctggtcatctgccccgaggggaccacgtgccgggagcccttcctgctgcgcttctcggcgctcttcgccgagctcaccagcgaggtggtgcccgtcgccatggagaacaggatgagcatgttccacggcaccaccgccagggggtggaaagggatggaccccttctacttcttcatgaacccgagcccggcctacgtcgtcaccttcctcaacaagctcccgccggagctcacctgcgccggcggcaggaccagccacgaggtggccaactacatccagaggctcatcgccgccacgctctcctacgagtgcacaagcctcaccaggaaggacaagtaccgggcgcttgcaggcaacgacggagtcgtcgccaccccaaagccgccgccaacggttgctagctagctagctaaggttattattattattattttttttaaaaaaaaagagagagaaagaaaattgggttattatattgtggtgatgatgctactgaattcattgtgattgttatgatgc

SEQ ID NO: 130 - DNA, 1744 bp, Ricinus communis
catttataacattttcagagagagagagagagagagtaatataaatatgccggcgatgaaacaggctcaaaagtttccgtcaataacatcatgcagcggcacctcatacgaatcaatagcagctgatctggatggtactctgctcgtctccagtagctcctttccttacttcatgctcgtggccgtggaagccggtagtctgttgcgtggtctagtgttgctgctttcgctgccttttatcatcatctcttatttcttcatatcagaagccatcgggatccaaatcctaatcttcatctctttcgctggtctcaaaatccgtgacatcgagcttgtttcccgcgctgttctgcctagattttatgctgcggatgtgaggaaagaaagctacgaggtgttcgataggtgcaagaggaaagtggtggtgacggcgaatccgacgattatggtggagccgtttgtgaaggattttcttggcggagacaaagttttgggaacggagattgaagtaaatcctaagacaaagagggccactggtttcgtgaagaagcctggcgtgttggttggcaaatggaagaagttggccattttgaaagagtttggagaggacgctcctgatcttgggatcggagaccgcaagactgatcatgacttcatgtccatttgcaaggagggctacatggtttatcacagcaaaaaagcagctactccactgccacgggatcgcctgaaaagtcctataatcttccacgatggccgttttgttcaacgaccggacccactcaatgccctcgctacctatctttggttgccatttggattcatgctctccatctttcgggtatacttcaatctaccactccccgaacgcatcgtacggtacacatacgagatgttaggcatccaccttgtgatccgtgggtacccacctccagcgccatcacgtggaacccctggaaatctatatgtgtgcaaccaccgtacagctttggatcctatcgtgattgcaatcgcactcggacgcaaagtttcgtgtgtaacatacagcgttagccgtctctcgagattcctatcaccaatcccagccatcgctttgacacgtgatcgtgcggctgacgcagaacgcatcacagctctactccaaaagggtgatcttgtagtgtgtcctgagggaactacatgtcgcgagcagtttttgttgagattcagtgcactgtttgctgaaatgagcgataggattgtgcctgtggcggttaattgcaagcaaagtatgttctatggcaccactgtacgtggggttaaattttgggacccttattttttctttatgaatccaaggccaacttatgaggtgacatttcttgatcggttacccgaagagatgacggttaaagcgggagggaaatcatcgattgaggtggctaattatgtgcagaaggttttgggtgatgtgttggggtttcagtgtactggattaacgaggaaggataagtacttgttgcttggagggaatgatggcaaggtggagtctatgtacaactccaaaaagtaagcatttggtttttcgtttctataagatttttagttacggatgtttgtaaggccagacatatcaaatattttagacattgatgtcgtcgtgctgaatttgcgcacagctttatatgcaagactcttttaagaatttggatgtccgatttcatggacgtgactggttaagatttcatgatgttataagggaatt

SEQ ID NO: 131 - DNA, 1539 bp, Ricinus communis
atggcaaaccctaaagaaacatatgctccttttagctcattcccaaatatagaaaagtgcacatccgtaggtcgacaaaacgacactgtagtgaccgatatggatggaaccctactttgtggacgtagcccgtttccttactttgccttagttgcctatgaagctagtggaatattaaggcttctattcttgctattaggttcgcctattgctggaattctccgctacttcatctccgaatctgctggaatccgagtacttgtatttgcaacctttgcagggatgcgagtgtctgatatagaatcggtggcaagagctgttttgcccaagttttattctagtgacttgcacccagagacttggcgggtgttctcttcgtgtgggaagaagtgcgtaatcacggaaaatcctaggattatggtagaggcattcttgaaagagtttgttggggctgatatggttattggcactgagattgttgtgcataaagggagagcgactgggtttattaggagtcccggtgttcttgttggacagaacaaggctgatgcgctaaaaatggctttctatgatgcgccggtgccaaatattgggatcggtgacaggaggactgatcgtccattcatgaaattgtgcaaggagagctacatagtcccaagcaattctcaagtagagccagttggtcctaaaaagttaccaaaacccatagttttccatgacgggcggcttgtccaaaaaccaacacatttaatcgcgcttgctactcttctttggattccagtaggctttattctcgcctgtctacgcttagccgccggtgcgctccttccaatgccattagtgtactacgccttgtgggcacttggtgttcgtattcacataaaaggcacaccaccgccgccagccaagaaatccactggccaagctggagtcctcttcgtatgttcccatagaactcttcttgacccggtcttcctctccatcgctttaggacgtccaatcccagccgtcacttactccctttcgcggctatcggagttcatttcacccatcaagactgtcaggctcactcgagaccgcgttactgatgcaaacatgatcaaggaactattacaagaaggtgacttagtcatatgtcctgaagggactacttgtagggaaccatttttgcttcggttttcagctttgttcgcggagttaaccgatgaacttgtccctgtcgccatggctaataagatgactatgtttcatggaacaacagctagaggatggaaagggatggaccccttctatttcttgatgaaccctagccctgcatatgaagtgacatttttgaacaagttgccttacaatttaacatgcggagcaggaaaatctagccatagtgttgctaattatatacaaaggacgattgctgcaactttgtcttaccaatgcaccagctttactaggaaggataaatatagagcacttgctggcaatgacggaactgtcgtggaggagcccaagcaggctcgtgatgaagtcatggattcctag

SEQ ID NO: 132 - DNA, 1515 bp, Ricinus communis
atggttatggtggacagcttcccagaagttagcaaatgtgcgtccaaaggccgagaaaagcacacggtggtcgctgatatggatggcaccctgtttattggtcgtagctccttcccttatttcgctctaattgccttcgaggctggtgggatttttaggcttcttttcttgctcttggcatcaccacttgcggcacttctttattactttgtttcagagtctgctggtattcaagttcttatctttgcatcctttgctggtatgaaagtatcggatattgaatctgtagcacgcgcagtgctgccaaagttctactccagcgatctccatcctgagtcatggcgtgtgttctcttcttgtgggaaacgctgcgttcttacagcgaacccaagaattatggtggaagcatttctgaaggatttcttgggagctgatttagtttttggtactgaaatatcaacttataaaggtagagctacaggttttgttcgtacccctggtgtacttgtaggcaagaacaaggcaaatgctcttaaaaaggcttttggagacgcaaggccagaagttgggcttggagataggcgcactgatgctccctttatggctttgtgcaaggagggatacctggtgccacccaagccggaagtcagggcagtaacaggtgacaagctcccaaaacccatcgtcttccatgatggcaggctagtccagaaaccaacaccattaatggcacttctcatcattctctggataccaataggcttcattctagcttgcttgagaattgcagcaggatcactcctgcctatgccaatggtctactatgccttcttagcactcggtgtccgtgtcacagtaaaaggcaacccacctcctccagccaagaaatcaactggtcaatcaggtgtcctctttgtttgctcccacagaactctccttgaccccatattcctctccactgcccttggccgccctattgccgcagtcacatactcagtatctcgcctctcggaaattatatcacccatcaaaacagttaggctcagccgcgatagagcaacagatgcagcaatgatcaagaagttgttagtagaaggtgacttagcgatatgtcctgaagggaccacttgcagggaaccctttcttttaaggttttcagctttgttcgcagaattaaccgatcaaattgtgccggtagctatggtgaacagaatgagcatgttccatggaactaccgctagagggtggaaagggatggatccattttacttcttcatgaaccctagtccagcttatgaagtaactttcttgagtaagttgccccaagaattaacgtgcagttcaggcaagtctagccacgaagtggctaattacatacaaagggtgattgctgctactctttcctatgaatgcactggatttactagaaaagataagtacagagcacttgctggcaacgatggcagtgttgttgagaaacctaagctcgaagccaacaaagtaatgggttgctaa

SEQ ID NO: 133 - DNA, 1804 bp, Arabidopsis lyrata
tttgtgctctctgttctttagagccgccattaacgagagagagagagagagagagagacttggcgagttataatgtctcccgcgaagaagagtggaaactttcctccgataacggaatgcagagacggagagtacgattcgatagccgccgatcttgacgggactctgcttctctcaagaagctcgttcccttacttcatgctggtcgccgttgaagctggaagccttttccgtggactaatactgcttctctcattaccaatcgtcattatttcttacctattcgtatccgaatctcttggaatccagatcctcatcttcatctccttcgctggtctcaaaatccgcgatatcgaactcgtctctcgcgcagttcttccacggttttatgcggcggatgtgaggaaagacagttttgatgtgtttgataagtgtaagaggaaagtggtagtgacggcgaatccgatagtgatggtggaggcgtttgtgaaggattatcttggaggtgataaagttttgggaacagagattgaagttaaccctaaatccaatagagccactggatttgtgaagaagcctggtgttcttgttggtgatcttaagaggttagccattttgaaagagtttggtgacgaatcacctgatctcggcctcggtgatcgaacctctgatcacgatttcatgtccctctgcaagaaaggttacatggttcatgcgtgcaagtcagccacaacaattccaaaagaacgtttaaagaaccgcatagtcttccacgacgggcgtttagcgcaacgtccaacgcccttaaacgccattgtcacatacctatggcttccctttggtttcatactctccatcattcgcgtctacttcaacctccctttacctgaacgctttgtccgttacacctacgagattctcggaattcacttaaccattcgtggccatcgtcctccacctccttcccccggaactcttggcaacctctatgtccttaaccaccgtaccgcgcttgatcccatcatcgttgctattgctcttggacgcaagatctgttgtgttacttacagtgtctctcgtctctcccttatgctttctcctattcctgctgttgccctcacccgtgaccgtgtcaccgatgctgccaacatgagaaaacttctcgagaaaggcgacttggtgatatgtccggaaggcacaacgtgcagagaagagtatctactgagatttagcgctctattctcagagctaagtgaccggattgtgccagtagcgatgaactgtaaacaaggaatgttcaacgggaccacagtgaggggtgtgaagttctgggacccttacttctttttcatgaacccaagaccaagctatgaagccactttcttggatcgtttgcctgaagaaatgactgtcaacggtggcggcaagactcctatagaggtggccaattacgtccagaaagttatcggcgcggtcttgggcttcgaatgcaccgaacttactcgcaaggataaatatcttttgcttggaggtaatgacggcaaggtggagtctatcatgttgggataaacttgaaataacttaagagataagttactaaaatgtaaaagagataaagctgaatattctaggagttatctagaataaatgtattaggagttttaattgatgatgtattggtacgttattgttatgttaattctatttttccctaaaactattttgtgatcacatttctatacgcatgtgcttaagggataataagaactttatatttaaagagcaaaattttattggaggaagt

SEQ ID NO: 134 - DNA, 1746 bp, Arabidopsis lyrata
atatccattctcaccttccaaatctctctcttctcttctctttccggcttcttcactaatgggagctcaggagaaacgacgtcgtttcgagcctatatcaaagtgcgacgttaaggaccggtccaaccataccgtggccgctgatctagacgggacactactgatctcacgtagcgccttcccttactatttcctcgtagccctcgaggcagggggcttgctccgagcattgatcctactcgtgtccgtaccgttcgtctatcttacgtacttgaccgtctcggagactttggccatcaacgtttttgtcttcatcacgtttgcgggtctcaagatccgagacgttgagctagtggtccgttccgtcctcccgaggttctatgcggaggacgtgaggcccgatacgtggcgtatctttaacacgtttgggaaacggtacatagtaacggcgagtcctcgaatcatggtcgagccgttcgtgaagacatacctaggagttgataaagttctcggaacagaactagaggtctccaaatcgggtcgggcaaccgggttcaccagaaaacccggtattctcgtgggtcagcacaaacgtgaagtcgttttgagagagtttggtagccttgcgtctgatttacctgatttggggctcggcgatagcaagacagactacgacttcatgtccatctgcaaggaaggttacatggtgccacgtacgaaatgcgaacccttaccaagaaacaaactcttaagccccataatattccacgagggcagattagtccaacgcccaacgccgttagttgctctgttaactctcctttggcttcccatcggtttcctcctctctcttatccgcgtctacacgaatattccgttaccggaacgtatcgcccgttacaactacaagctcactggcatcaagctaatcgtcaacggtcaccctcctccgccgccaaaacctggccaaccaggccatctcttggtttgtaaccaccgcaccgtccttgacccggtggtgacagccgtcgcgctcggccggaaaatcagctgcgtcacttatagcattagcaagttctctgagctaatctcaccaatcaaagccgttgcgttgactcgtcaacgtgagaaagacgcagcgaacatcaagcgccttttggaagaaggcgatcttgtgatctgtcccgagggaactacgtgccgtgagcctttccttctccggtttagtgccctcttcgctgagctcacggaccggattgttcccgtggcgatcaacacgaagcagagcatgttcaatggtactaccacacgtggctacaagcttcttgatccttacttcgcgttcatgaacccgaggccgacgtacgagatcacgttcctcaaacagattcccgctgagctgacgtgtaaaggaggcaaatcgccgatagaggtggcgaattacatacaaagggttttgggaggaaccttaggttttgagtgcaccaatttcacaagaaaggataagtacgcaatgcttgctggtaccgacggtagggttccggtgaagaaggagaagacgtgattattgatcggagaatggagaaaacgaagaaataatacaaagattggaatcttttttcatttggatggttaattatcaatatttaaggggcaaagaattgataagtttatttttttgttgtttcctttatcttctctgcttcgatgaatgtttcaagatttacttttagtacaataacggtt

SEQ ID NO: 135 - DNA, 1509 bp, Vernicia fordii
atgtcgcaaacgaaaccggctccaaaattcccttcaataacatcatgtaccggctcggcgtatcagtcaatagcggctgatcttgatggcacgctcctcgtgtccagtagctccttcccttacttcatgttagtggctgtcgaagctggtagtctcctccgtggtctggtgtcgcttctgtctctacctcttgtgatcatctcctattttttcatatctgaagccgtcggaatccaaatcctaatctatatctcctttgctgggctcaagatccgcgacatcgagctggtttcccgcgctgttttgcctaggttttatgctgctgatgtgaggaaggagagttttgaggtttttgacaaatgcaagaggaaggtggtggtgacggcaaatccgacgattatggtggagccatttgtgaaggattttcttggcggagacaaggtgttaggtacggagattgaagtaaatccaaagactaagagggccaccggattcgtgaagaatcctggcgtgttagtggggaaatggaagaaattgtccattttgaaagagtttggagaggaatcaccggatcttgggatcggagaccgcaagacggatcatgatttcatgtccatttgcaaggagggctacatggttcaacgcagcaaatcagctactccaataccactggatcgtctcaaaagtcgtataattttccatgatggccggttcgttcagcgacctgacccactgaacgctcttgtcacctatctttggctgccatttggattcatcctctctattattcgcgtatacttcaatctcccactcccagaacgcatcgtacggtacacatacgagatgctaggcatccaccttgtgatccgtgggaacccgcctcctgccccatcacctggaaccccaggaaatctctatgtttgcaaccaccgctcagctttggatcctattgtcattgcaatagcacttggacgcaaagtttcctgtgtaacatacagcgtaagccgtctctcgaggttcctatctccgattccagctatcgctttgactcgtgatcgtgccgctgatgcagcacgcatctcagagctactccaaaagggtgatcttgtagtgtgtccagaggggactacgtgtcgcgagccgttcctgttgcgattcagtgcattgttcgcagaaatgagcgataggattgtgccggtggcggttaactgtaagcaaaatatgttctatggtaccaccgtacgtggtgtcaagttttgggatccttattacttcttcatgaacccaagaccaacctatgaggtgacattccttgatcggttgccggaagagatgacagctaaggcgggagggaaatcgtcgatcgaggtggctaattatgtgcagaaggtgttgggtgatgtgttgggattcgaatgcactggattaactagaaaggataagtatatgttgctaggaggaaatgatggcaaggtggagtcaatgtacaacaccaaaaaagccggttaa

SEQ ID NO: 136 - DNA, 1545 bp, Oryza sativa
atgggggacgccacgatgatcgcgtcgccgttcccggcggtggagaagtgttcgtccaaggaccgcggcggcgacacgatcgtcgccgacctcgacggcacgctgctgtgcggccggagctcgttcccgtacttcgcgcacatggcgttcgagacggggggcgtcctccggctgctggcgctgatcctgctggcgccgctcgccggcgtgctctactacctggtgtccgagtcggccggcatccaggtgctcatcttcgcgtccatggccggcgcgagggtcgccgacgttgaggcggtggcgcgcgccgtgctgcccaagttctactgctccgacatccacccggagtcgtggcgcgtgttctcggcgtgcgggcgccggtgcgtgctcaccgcgaacccgaggatgatggtggaggcgttcttgaaggagtacctcggcgccgacatcgtcgtgggcacggagctcgtggtctggcgtggccgcgccacggggctcgtccggagccccggcgtgctcgtcggcgagaacaaggcggccgcgctccgggaggcgttcggcgacgcctcgccggagatcggcatcggcgaccggaggacggactacccgttcatgaggctatgcaaggaggggtacgtggtgccggtgtcgccgacgccgaggcccgtgccgcgggaggagctcccgaagccggtggtgttccacgacggccgcctggtccagaagccgtcgccggcgctcgcgctgctcaccgtgctctggatccccatcggcttcgtgctcgcctgcctccgcatcgccgccggcgcgctcctcccgatgcgcgtggtgtaccacgccttccgcgccctcggcgtgcgcgtcaccgtcaagggcaccccgccgccaccggccagccgcgagaccggccagtccggcgtgctcttcatctgctcccaccgcaccctcctcgaccccatcttcctctccaccgccctcggccgccccatcaccgccgtcacctactcggtgtcgcggctgtcggagatattgtcgccgatcaggacggtgcggctgacgcgggacagggcggcggacgcggcgatgatccggcggctgctggcggagggcgacctggtgatctgcccggaggggacgacgtgccgggagccgttcctcctccggttctcggcgctgttcgcggagctcaccgacgagatcgtgccggtggcgatggagaaccagatgagcatgttccacggcacgacggcgagggggtggaaggcgctggaccccttctacttcttcatgaaccctagccccggatacgtggtcaccttcctcagcaagctccccggcgagctcacctgcaacggcggtggcggcggcggcggcggccggagcagccacgaggtggccaactacatccagaggctcatcgcctccacgctctcctacgagtgcaccagcttcaccaggaaggacaagtacagggcgctcgccggcaacgacggcaccgtcgtgtccaagcccaacatcgacgagaagaaggccatgggatgttaa

SEQ ID NO: 137 - DNA, 3343 bp, Brassica napus
aaattaaacaaatttgatagaatatacattttttttatcagatctttattattcaaaatcattaattgtcatatatactttatccacattaggcaattccgtaatctttatttaaggaaataataaatgacattaataatgaatttatggttagtttaataaaaaaacttattatataattagatgaccaacctatttctctaataattctaagaatcatcctagtgataacatgtgtctacaaaaagaagttgtaatgtttcacaaataatatacaggggatcagttattttcatcaacatagttggatacacagctgtatagacattaattggtaaagctatacatagccaaagtatattaatgagtcactcaactaatgagacggccttctatttaggtgagctggtaagctacttcctttcatgtcgatcaacaaaaaataaataaggcttttcttttagtcctaactccgaagagaaccgcgtgacctaaactatagtatttattacacatattgatccacgattgatagataatattcaccacttttcattatatttacatactaatgcaaacctatgtagtaaaattaatcacatattgaattatgacttataaaatgtaatcgtataacaaaaagatggatggtttaagccaaagactttgttacgactcttgtaatggggaatttatatatttaagtgagaatgatgacaaagtgagaaagaatcaggttataattgttagaaatgatagtttaaggataaatttgtaaagaagtcatattggataaggagtgacaatattataaatcggtaaggaatgcagcgcatttaaaacaagaaagaccccttccctctctttctttccaagattctctctctctgtttaccatcaaagagagatcgaaaaatgtctccggcaaagaagaagagcagaagctttcctccgataagcgagtgtaaacgtggagagtatgattcgatcgccgcagatctcgacgggactatgctcctctcgagaagctccttcccttatttcatgctcgtcgccatagaagcaggcagcctcttccgtggattgatcctccttctatctctcccgatcgtcatcatcgcctacctcttcgtctccgaagctctcggcatccaaatcctcatctacatctccttcgccggcatcaaaatccgcgacatcgagctcgtctcccgcgccgttcttccacggttctacgcggcggatgtgaggaaggacagtttcgaggtgtttgataaatgcaagaggaaagtggtggtcactgctaatcccatagtgatggttgagcctttcgtcaaggattacttgggaggagataaagttttgggaacagagatcgaagtgaatcccaaaacgatgaaagccacggggtttgtgaagaagcctggtgttcttgttggagacttgaagagattagccatcttgaaggagttcggggaagaatcaccggatcttggcctcggtgaccgcacctccgatcatgatttcatgtccatttgcaaggtactataaacatatacgtttaagtttcttgaatttttaagaaccccggtttaggtgaaaatcgagtgcataaacgtctgatactttgaaacatttcgtaatcaaagaagtaagtacttgaaaactacacataaatgcagtaggacctatttaatgccgtgttgcgtgttcacatgccttcacatgatctattcacttttttttacgtccaaattatttgtatgtgtgtgtatgtataataaaaacacgcatgaaatatctagattaagtagttttgttatttgaattcaagaaaggaacgtaataagtttccggtgacaaaaaaatgtagataatagaatagaatagtagtagtgattttcataaatgcttcctaccttatcaccaaccgcccatccccacataagttgaatggtcccatttaatgaccgaacccatatgtcaacattcctttctttctttttctcctaaccactgaaactttcagtaatttacgagctttcttactataattgtgtaactttggaatcttttactacatgattggtaacgacttgcttttctcttgtaacaggaaggttacatggtgcatgagtccaaatcagccacaacagtccccatagaacgtctcaagaaccgtataatcttccacgacggccgtctagtccaacgccctacgccgttaaacgccataatcatttacctttggcttcctttcggtttcatgctctctatcttccgcgtttacttcaacctccctttacccgaacgcttcgttcgctatacttacgagatcctcggtattcacctaactatccgtggccaccgtcctcctcctccttccccaggcacacctggaaacctctacgtccttaaccaccgtactgctcttgaccccattatcatcgccattgctctcggccgtaagatctcttgcgtcacttatagtgtctctcgcctctcccggatgctctcacccatccctgccgtcgctcttacccgagaccgcgccgctgatgctgctcgcatgagaaaactcctcgagaaaggtgacatcaacccttgttactatcattctatatcattggtttcatcatctcatgagttccaatatgaaaataatataggttttgaaagccttcagtcaaaaaataaaaatattgtaggtttccatgtcacggttacttttaagaatcaactgcataactagaaaacataaaacatagcatctttgtgtgttttctatacatattatcacgctaggcacaaaagatagttggagaatcagatagcgttcgtctatataaaagtgggaaacagagcatctatgtttactagatataaggtccatcacataagtcttttattatttttgtaacaggtgatttggtgatctgccctgaaggcaccacttgtagagaaccgtatctactacgatttagcgctctatttgcagagctcagcgaccggatcgtgcccgtggccatgaactgcaagcaagggatgttcaacggaaccacagtacgaggtgtaaaattctgggacccttacttcttcttcatgaacccgagacctagctacgaggccactttcttggaccgtttgcctgaagaatggacagtaaacggcggcggtaaaactccaatagaggtggcaaattacgttcagaaggtgatcggtggagtattgggattcgagtgcactgagctcacaaggaaggataagtatcttttgcttggaggcaacgacgggaaggttgagtctatcaataagagcaaggccaaggagtaataaatccagc

SEQ ID NO: 138 - DNA, 1503 bp, Populus trichocarpa
atgtcgccaacgaaacccgcaaaaaaatttccgccgataacggcctgtaacggcacgacgcaccaatctatagcagcggatcttgatggcacactccttgtgtcgagtagctcgtttccatactttatgattgttgctgttgaagctggaagcctctttcgtggtcttgttttacttctttcactgcctatcgtcatcgtgtcttacctcttcatatctgaagccttggggatacaaatgttaatcttcatttctatgtctgggctcaagatccgtgatattgaacttgtttcacgcgctgtattgcctaggttttatgctgcagatgttagatcggagagttttgaggtgtttgataggtgcaagagaaaggtggtggtgacagcaaatccaactataatggttgagccttttgtgaaggattttctcggtggagataaggttttgggcacggagattgaagtgaacccgaagaccaagagggctacaggatttgttaagaagcctggtgttctggtgggcaagtggaaagaattggctgttttaaaggagtttggagaggaagcaccggatcttggtattggtgaccgcaagactgatcatgatttcatgtccctttgcaaggagggctacatggtgcatcgcagcaaatcagcgactccactaccgcgggatcgcctcaaaaatcgtatcatcttccatgatggccgtcttgttcaacgtccagacccactcaatgccttgatcacttacatttggttgccgtttggattcatcctctccatcattcgcgtctacttcaacctcccactcccagaacgcatcgtacggtacacatacgaaatgcttggcattcacctggtcattcgtgggaccccacctcctgccccatcacctgggaccccaggaaatctctatgtttgcaatcaccgtacagccctggatccaattgtcatagccatagcacttggacgcaaagtctcgtgtgttacgtacagcgtaagccgtctctcgaggtttctttcaccaatcccagccatcgctttgactcgtgatcgcgcggctgatgctgcaagaatatcatccatacttcaaaagggtgatctagtggtgtgtccggagggaaccacttgtcgtgaggagttcttgctgcgatttagtgcattgtttgcagagttgagtgataggattgtgcccgtggcagtcaattgtaaacaaaacatgttttatggcacgaccgtgcgtggtgtcaagttctgggatccttattttttcttcatgaacccgaggccaacttacgaagtgacattccttgatcgcttgccagaggaaatgacggtcaaggctggtggcaaatcttcgatcgaggtggcaaactatgtgcagaaagtgttgggtgaagtgttaggattcgagaacactgggttgaccaggaaggacaagtacctgttgcttggtgggaatgatggtaaggtcgagtcaatgcacaatgccaaaaaataa

SEQ ID NO: 139 - DNA, 2117 bp, Sorghum bicolor
gccgagctcgactcggaatccgatcccccacccaactccatgctccgattcctcctcccttctctgctccgactccgaccaccaccacctctgctgccagccccgtcctacatataaatccctccgtcatcatcgtcaaccgcagcgttgggccgctcaacaaacgcagccaccgccgccgccgccaccacgacaccaaccatataatcgcctgcccaagtcccaaccttttccgacccagccagacaccaccaccaccgtcgtcttcctcgccatggcccccgcggcgagcgcgaggttcccaccggtgtcatcctacgacgcgtccgcacgcacccgccgaaccgccgccgcggacctggacggcacgctgctcgcgtcctcctcggcgttcccctactacttcctcgtggcgctcgaggccggctcgtgcctccgcgcggcggcgctcctcctcgtggctccgctcctgctagcgctctacacgctggtgtccgaggcggcggccatcgcgctgctggcgttcgtcacgttcgcggggctgcgcgtgcgcgacgtcgaggccgtcgcccgcggcgtcctgccgcggcactacgcggccggcgtgcgcgccgacacctggaccgtgttccgcggctgcggcgaggggaggagggtcgtcgtcaccgcgtcccccgccgtcatggtgggcgagttcgtacgcgagttccttggtgctgaggtcgctggcaccgagctcgagaccttctccgcgttcggcgccgccaggtttacggggaggatcaaggccgtgctcgtcggggagaggaaggcggaggtcgtccggcggctcttcgccggtggggagatgcccgacgtcgggcttggggaccgcgagagtgaccatgacttcatggccatctgcaaggaagcttacatggtgcctccggacaagcgcgcggcgcgtgcggccgccgacacgctgctgtcccgctccgtcttccacgacggccgcctcgtccagcgcccggacccggcgcaggcgctgttcgcgctggcctacctcccgctgggcttcctgctggcgctgttccgcgtcttcttcaacctcatgatgccgctacgcctggtccgccacacgtaccgcctgacggggatccgcctccgcgtccggggcacgccgccgccgcccccggcgccgggcgccccgggttcgctgctggtctgcaaccaccgcacggcgctggacccgatcatcctgtccgtggcgctgggtcgccccgtgtcgtgcgtcacgtacagcgcgagccgcctctcgacggcgatctcgccgatccgggccgtcgcgctgtcccgggaccgcgccaccgacgcggcgcgcatggcggcgctgctggcggagggcgacgtcgtcgtgtgccccgaggggaccacgtgccgggagccctgcctgctccggttctcggcgctgttcgccgagctcacggaccggatcgtgcccgtggccatggaggcgcggcagggcacctactacgggtcgacggcgagggggtggaagtggctcgacccctacttcttctacatgaacccgcggccaggctacgacgtcacgttcctgccgccgctgcggccggaggagacgtgcggcgccggcgggaggagcgccgtcgacgtggctaaccacgtgcagagggtcatcgccaaggagctcgggttccagtgcaccacgctcaccaggaaggacaagtacatgaagctcgccggcaacgacggctcggtcgccgccagggctaaaaaggacgccgccgatgataacgctgccacggtcaccaccaccaagaagtttgtatgaagagatcgattatatatattggcaacctagctcgactatatcggagcagcattgtactgacgtaaaaaaaaaaaaaacatgcatgcacaaaaggtctagttaggcttatgtatattggagtatcgtgttcttttatttatactacgtatacgtagaaagaatggacgagtgaatggagtccaattttaaaggcgcaatttatatatgattatgattattttgggtagtgtatttgcttaaaaatctaaacacatactaaattgcattgcaacaatttaaatttttt

SEQ ID NO: 140 - DNA, 1547 bp, Ricinus communis
acacatatttcccactgctactagcttcccaaaactcacaccttaatctatcaaattggtcatgggggctcatcggcatttcgagtcaatcaagaaatgcagcaccgagggacggtcgaatcagacggtggctgcagacctggacggcacacttcttgtttcatcaagtgcttttccatacttcttgctcgttgcacttgaagctggaagcgtgttaagagctatactccttttagcatctgttcctttcgtgtattttacgtacctggttttatcagaggcaatagctatcaaaaccttcatctttattgcctttgcaggacttaaaataagggacgttgagcttgtttcgcggtctgtcttgcctagattctacgcggatgatgtccatcctgaaacttggagagtgttcaattcttttgggaaaagatatattgtcaccgccagtcctaggattatggttgaaccttttgttaagacctttttaggtgctgacaaagttcttggcactgaactagaggttacaaaatcgggaaaggcaactgggttcgtcaagaaacctggaattcttgttgctgaacataaaagagatgccattttaaaagaactgggcgctgatttgccagatttaggcctgtggagaccgagaaactgaccacaatttcatgtctatttgcaaggaaggatatatggtgccaagaacaaagtgtgagccactaccaagaaacaagcttctaagccctgtaatattccatgaaggacggttagttcaaaggccaacacctctagttgccctcttgacctttttatggatgccaatcggtataattctctcaatccttagggtataccttaatatccctttacctgaaagaattgcctattacaattacaaaattcttggaattaaagttatagttaagggcacccctcctcctgctccaagaaaaggccaaagtggagtcctttttgtatgcaaccatcgtactgttttagacccagtagtgacagcagttgccttaggcagaaagatcagttgtgttacatatagcataagcaaattcacagaaatcatatcgccaatcaaagcagtcgcattatcaagagaaagagagaaagatgctgctaatattaagcgtttattagaagaaggtgacttggtcatttgccctgaaggaacaacttgtagagagccatttcttttgagatttagtgccctttttgctgaacttaccgacagaattgtgcctgttgctatcaataccaagcaaacagttttccacggcacgactgtccgagggcataaattattggacccttattttgtgttcatgaatccaatgccaacctatgagatcacattcttgaatcagttgcctatagagcttacttgcaaaggtggtaaatcgtcgatcgaagttgccaattacattcagagggttcttgctggtacattggggtttgaatgtactaatttgacaaggaaggacaagtatgctatccttgctggtacagacggtcgtgttccatctaagaaggaaaagtaa

SEQ ID NO: 141 - DNA, 1549 bp, Arabidopsis lyrata
aagattcgccgcaagaaaacatgtctccggcgaagaagagccgaagttttcctccgataagcgagtgtaaaagcagagagtatgattcgatcgctgcggatctcgacggcactctgcttctctcaagaagctctttcccttacttcatgctcgtcgccattgaagcaggtagtctcttccgtggattgatccttcttctttctcttcccatcgtcatcatcgcttatctcttcgtctccgaatctctcggaatccaaatccttatctacatctccttcgccggtatcaaaatcaagaacatcgaactcgtctctcgcgccgttcttccacggttttacgcggcggatgtgaggaaagatagttttgaggtgtttgataaatgcaagaggaaagtggtggttactgcgaatccgatagtgatggttgagccattcgtcaaagattatttgggaggagaaaaagttttgggaacagagattgaagttaaccccaaaacgatgaaagctactggttttgttaaaaagcctggtgttcttgttggtgatttgaagagattagccatcttgaaagagttcggcgaagaatcaccggatattggactcggtgaccggacctccgatcacgatttcatgtccatttgcaaggaaggttacatggtgcatgagaccaaatcagccacaacagtccctatagagcgtctcaagaaccgcataatcttccacgatggccgtcttgtccaacgtccgacgccgttgaacgccttaatcatttacctttggcttcctttcggctttatgctctctatcttccgcgtctacttcaacctccctttacccgaacgcttcgttcgctacacttacgagatcctcggcattcacctcacaatccgtggccaccgtcctccccctccttcccccggcaaacctggaaacctttacgtccttaaccaccgaaccgcccttgaccccataattatcgccattgctctcggccgtaagatcacatgtgtcacttatagtgtctctcgcctctccctgatgctctcacccattcctgctgttgctctgacccgagaccgtgtcgctgatgcagcccgcatgagacaactcctcgagaaaggtgatttggtgatctgtcctgaaggcacaacgtgtagagaaccatatctactaagattcagtgctctatttgcggagctgagcgaccggatcgtgcctgtggccatgaactgcaagcaagggatgttcaacgggacgacagttagaggtgtgaaattctgggatccgtacttcttcttcatgaaccctcgacctagctacgaggccactttcttggaccgtttgcccgaagaaatgacggtaaacggtggtggcaagactccttttgaggtggctaattacgttcagaaggtgatcggtggagttttggggttcgaatgcactgaacttacaaggaaggataagtatctgttgcttggaggcaacgacggaaaggttgagtctatcaataagaccaagtccatggactaataatctagctagttactggt

SEQ ID NO: 142 - DNA, 1995 bp, Arabidopsis thaliana
ccaacacatttacttttcttcttcttctctctctacgccatagctatggttttaccagagcttctcgtgattctagcagaatgggttctttaccgtcttcttgctaaatcatgttacagagctgctagaaagctcagaggctatggtttccagttaaaaaatctcctaagcctctccaaaacacaatctctacacaacaattctcagcatcatcttcataaccatcatcaacaaaatcaccctaaccaaacccttcaagattctctagaccctctgttcccaagccttacaaaataccaagaacttcttctagacaaaaacagagcatgctctgtttcgtctgatcattatcgtgatacctttttctgcgatatcgatggtgttttattaagacaacattcgagcaaacacttccacacgttcttcccttacttcatgctcgtggcttttgaaggaggatcgatcatcagagcgatccttctcttgctctcctgttctttcctttggactctgcaacaagaaaccaaactcagagttctctctttcataaccttctctggtcttagagtcaaagacatggacaatgtttctagatcggttctaccaaaattcttcctcgagaacttgaatatccaagtttacgacatctgggctcgaactgagtactccaaagttgtgttcacgagcttgccgcaagtgctggtggagaggttcctcagagaacatctcaacgctgatgatgtgattgggactaaactgcaagaaataaaagtcatgggaaggaaattctacacaggcctagcttctggttctggtttcgtcctgaaacataaatcagctgaagactacttttttgatagcaagaagaagcctgcacttggaattggaagctcttcaagcccacaagatcacatcttcatctccatttgcaaagaagcttatttttggaatgaagaagagtccatgagcaagaacaacgcattgcctagagaaagatacccaaagccactgatattccacgacgggagattggctttcttgccaacaccattagctacattagccatgttcatatggctccctatcggatttttactcgctgtcttcaggatctcggtaggagtctttcttccttaccatgtagccaatttcttggcttctatgtccggtgttaggatcactttcaagacccataatttgaataacggtcgtccagagaaaggtaatagtggagtcttgtatgtatgcaaccataggaccctcctcgacccagttttcctcaccacttcgctgggcaagcccttgaccgcggttacttacagcctaagcaagttctccgagttcatagcacctctcaagacggttagccttaaaagagataggaagaaagacggtgaggcaatgcagagactattaagcaaaggagatctagtggtttgtccggagggaaccacatgtagagagccttatctactaaggttcagtcctttgttcgctgagttaactgaagacattgttcccgtggctgtagatgctcgagtgagcatgttctatgggacaactgcgagcgggctcaagtgtttagaccctatcttcttcctcatgaaccctaggccggtttattgtcttgagattttaaagaagttgccaaaagagatgacttgtgcaggaggcaagtcaagctttgaagttgcgaatttcatacagggagaacttgctagggttttgggatttgaatgcactaatctcacaaggagggataagtacttggttcttgctggaaatgaaggcattgtcagataaactattccgaattttcattagtttttttgtttgtttgaaaagctaaatattattgttatttcaggacttagatgtttaattctatatggttgattcattggcatcatttctatttcttatcactcgggaccattgatatgtattgaaaatgtttgctttatatgattttgtttctggatttgtatagtccat

SEQ ID NO: 143 - DNA, 1828 bp, Arabidopsis thaliana
gtctgaaaccaaacaaagaaaatacacgaaggaaggaaaagaaaagtaaaaagaaaagctttctgcaaaatccaaacatgtccgccaagatttcaatattccaagctcttgtctttctattctaccggtttatcctccggcgatatcggaactctaaaccaaaataccaaaatggcccttcttctctcctccaatccgacctatcacgccacacattgatcttcaacgtagaaggagctcttctcaaatccgactctctcttcccttacttcatgttagtagcatttgaggcgggaggcgtaataaggtcatttctcctcttcattctctatccattgataagcttgatgagccatgagatgggtgtcaaagtgatggtaatggtgagcttcttcgggatcaaaaaagaaggttttcgagcggggagagcggttttgcctaaatactttctagaagatgtcggactcgagatgttcgaagtgttgaagagaggagggaagaaaatcggagtgagtgatgatcttcctcaagttatgatcgaagggttcttgagagattacttggagattgacgttgtggtcgggagagaaatgaaagtcgttggaggttattatctaggtatcatggaggataaaaccaaacatgatcttgtctttgatgagttagttcgtaaagagagactaaacaccggtcgtgttattggcatcacttccttcaatacatctcttcaccgatatctattctctcagttttgccaggaaatttatttcgtgaagaaatcagacaagcgaagctggcaaaccctaccacgaagccagtaccctaaaccattgattttccatgatggccgtctcgcgatcaaaccaaccctaatgaacactttggtcttgttcatgtggggtcctttcgcagccgcagccgcagcagccagactcttcgtctctctttgcatcccttactctttatcaatcccgatcctcgccttttccggttgcagactaaccgtcactaacgactacgtttcatctcaaaaacaaaaaccaagtcaacgcaaaggttgtctctttgtttgtaaccataggactttattggaccctctctatgttgcattcgctttgagaaagaaaaacatcaaaactgtaacgtatagtttgagtagggtatctgagattttggctccgatcaagacggtgagactgacccgtgatcgggtgagcgacggtcaagccatggagaaattgttaaccgaaggagatctcgttgtttgtcctgaaggaaccacttgtagagaaccttacctgcttaggtttagccctttgttcaccgaggttagtgatgtcatcgttcccgtggctgtgacggtacacgtgaccttcttctacggtacaacggcgagtggtcttaaggcacttgacccgcttttcttcctcttggatccttatcctacctacaccatccaatttctcgaccctgtctccggtgccacgtgccaagatcctgatggaaagttgaagtttgaggtggccaacaatgttcagagtgatattgggaaggcgttggatttcgagtgcacaagtctcactagaaaagacaagtatttgatcttggccggtaataatggagtagttaagaaaaattaaaatttgttttaggatgatgagtgagtgatgagttcggttctttgggtatgtaagtaaccaatcgattatttcatttgtttattaataatgtctacgtaaatgtaactacaatctttttttcttggtaatgtacacatatgttctatatcatatccaaaatctttgtcagacaattttgcctttcatgc

SEQ ID NO: 144 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFMSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 145 - protein, 501 aa, Arabidopsis thaliana [sequence omitted]

SEQ ID NO: 146 - protein, 289 aa, Arabidopsis thaliana
MVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 147 - protein, 503 aa, Arabidopsis thaliana
MSPAKKSRSFPPISECKSREYDSIAADLDGTLLLSRSSFPYFMLVAIEAGSLFRGLILLLSLPIVIIAYLFVSESLGIQILIFISFAGIKIKNIELVSRAVLTRFYAADVRKDSFEVFDKCKKRKVVVTANPIVMVEPFVKDYLGGDKVLGTEIEVNPKTMKATGFVKKPGVLVGDLKRLAILKEFGDDSPDLGLGDRTSDHDFKSICKEGYMVHETKSATTVPIESLKNRIIFHDGRLVQRPTPLNALIIYLWLPFGFMLSVFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSME

SEQ ID NO: 148 - protein, 467 aa, Oryza sativa
MAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 149 - protein, 512 aa, Picea sitchensis
MAKGQSGLDCQGLFDVISKCSSKGRENQTVAADLDGTMLRSRSSFPYFMLVAMEGGSLLRGMVLLACAPMAWFLYNFISEAAGIQLLIFISFAGLKIRDIELVSRAVLPKFYAEDVHPESWRVFSAFGKRYIVTANPRIMVEPFVKGYLGADKVLGTELQVSRSGRATGFVKKPGVLVGDLKKAAVEAEFGDKLPELGLGDRETDHPFMSLCKEGYMVPKMKVDEVPTNKLMSPIVFHDGRLVQRPNPGAALLTFLWLPIGFFLAQFRVFGNIPIPEKYVKISYKIMGIKLVVKGTPPPAPKKKGERGVLFVCDHRTLLDPVIVAVALGRKVSAVTYSISRFSEIISPIKTVRLTRDRERDAANIKRLLEEGDLVICPEGTTCREPFLLRFSALFAELTDRIVPVAICNKMSMFHGTTVRGWKGFDPFFFFMNPVPTYEVTFLDQLPTELTCAGGKSPIEVANYIQRVLAATLGYECTNFTRKDKYRMLAGNDGIVSLNKTATARSNNHKQN

SEQ ID NO: 150 - protein, 502 aa, Zea mays
MVASPRFKPIEECCSEGRSEQTVAADLDGTLLISRSAFPYYLLVALEAGSVLRAALLLLSVPFVYVTYAFFSESLAISTLVYISVAGLKVRSIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKEKDKN

SEQ ID NO: 151 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRSSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 152 - protein, 486 aa, Oryza sativa
MSPFKPIEQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDQVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 153 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTPDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 154 - protein, 486 aa, Oryza sativa
MSPFKPIKQCSTEGRSQQTVASDLDGTLLLSRSAFPYYLLVALEAGGPLRAVALLMSVPFVYLTYVTISESLAVRALLYIAVAGLEVRDVESVARSVLPRFYAGDVHPEGWRVFSSFGRRCVVTASPRVMVEPFARAFLGADRVIGTELEVGEDGRATGFVAKPGVLIREHKRNAVVREFGDALPDVGMGDRESDFDFMAICKDAYVVTTSRKHRPVPESQLLRTVVLHDGRLAQRPTAINTLLVFLWMPVGFALALLRACLSLLLPERVLSYAYKLTGVGLVVRGRPPPPDGSPGVLFVCNHRTVLDPVAVAAALGRKVICVTYSVPRKTYGMSSRLPEALTASPVKAAVALCRERDRDADRVRRLLEEGVDIVAFPEGTTCRGAFLLRFSSLFAELTDRIVPVAIATRETMFHGSTARGFKGMDPYFFFMNPRPAYEVTFLSQLPSELTSGGGGKSPVEVANYVQKALAGQLGSEHIGITRKEK

SEQ ID NO: 155 - protein, 507 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRAETWAVFHGWAKRRVLVTALPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGARRRPLRPGDAGAPSCCATTEPPRTPSSCPSALAAPLRALRTALAPLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 156 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFVLALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 157 - protein, 505 aa, Oryza sativa
MIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGRSSHEVANYIQRLIASTLSYECTSFTRKDKYRALAGNDGTVVSKPNIDEKKAMGC

SEQ ID NO: 158 - protein, 474 aa, Oryza sativa
MGDPPMIASPFPAVEKFSSKDRGGDTIVPDLDGTLLCGRSSFPYFGHMAFKTGGVLRLLALILLAPFAGLLYYLVSDSAGIQVLIFASMAGPRVPDFKAAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 159 - protein, 497 aa, Selaginella moellendorffii
MADLKYSRLVQFGLVENCSSEGRGMHTVAADLDGTLLRRRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFLGLAAERDVTGLTYSISRVSEVLSPIVTVRLTRDKERDFTKMKSLLERGRDLCLCPEGTTCREPFLLRFSALFTQLTHRIVPAAVKTRQSMFNGTAVRGWKGMDPFFFFMNPFPTYEVEFLEELPAEMSVQKGGKSSFETANFIQKMLGDKLGYECTTFTRKDKYLMLNGSDGTVPTK

SEQ ID NO: 160 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPKDEQAAQGQDQVNGCS

SEQ ID NO: 161 - protein, 494 aa, Selaginella moellendorffii
MAEFPPIEKCGTTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEVDNRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRYKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVETKKST

SEQ ID NO: 162 - protein, 494 aa, Selaginella moellendorffii
MAEFPPIEKCSSTISRESESVASDLDGTLLRGRSSFPYFFLTTFETSGILRSWLLLLVSPLVWLLYHFISEAAGIKLLIFASLAGVPVSQIECIARSVLPRFYLQDLNPETWKVFSSFGKKIVVTANPRILVESLCKEFLGADEVIGTELEMDSRGRATGFVKSPGVLVGENKAKALLQACDPEQLPDVGLGDRQTDFPFMKLCKEGYVVPPSNNVEPVPKSQLLKPIIFHDGRLVQLPTPLVALVTLLWIPVGFVLACLRIAAGSLLPMSIVYHAFWLLGVRVTVKGTPPPRATKNSRGVLFICSHRTLLDPIFLSCALGRGVSAVTYSVSRLSEILSPIKTVALSRNRDKDAAQIRELLKEGDLVICPEGTTCREPFLLRFSALFAELADDIVPVAMDNRMSMFHGTAARAWKGMDPFYFFMNPSPSYEVTFLQQLPEELTCKGGKSSHEVANHIQRALAGVLDFECTNLTRKDKYKALVGTDGSVESKKST

SEQ ID NO: 163 - protein, 490 aa, Selaginella moellendorffii
MEHPYDVIDNCSADNREKQSVVADLDGSCVRSRSSFPYFMLVALEGGSLLRSVLLMVMAPVAWLLYHFVSEAAGIKVLIFFSCAGQRARDIEAVARAVLPKFYSEDVHSSTWRVFSSCGKRYILTASPRLMVEHFATTYLGADKVIGTELQVTRSGYATGFVKSPGVLVGVNKRRALKAVFGEEVPDLGIGDRSSDYPFMAFCKEAYIVPSQPADAVPAHKLARKIIFHDGRLVQRPTPFVALVTFLWLPAGFLLAFFRILVALPCPVEYVPLLYKVIGVRLIVKGKVPPPSKNGILFVCTHRTLIDPIMASAASGSDVTALTYSISRVSEVLSPIKTVPLSRDRERDASNIKRLLLKENLAICPEGTTCREPFLLRFSALFAELSENIVPVATSTKTSIFHGTTVRGWKGMDPFFFFMNPFPVYEVTFLERLPHDLSVQGGKSAIEVANYIQRVLADTLGFECTNFTRKDKYGMLIGSDGTVPARKKSF

SEQ ID NO: 164 - protein, 497 aa, Selaginella moellendorffii
MADLKYSRLFRFGLVENCSSEGRGMHTVAADLDGTLLRGRSSFPYFLLVALEGGSLFRAVVLGLLAPIAWLLYHFVSEAAAIQLLIYVSFSGQKVSEIEKVATAVLPKFYSQDVHSDAFRVFSSCGKKYVITANPRIMVEYFCKAFLGADKVIGTEIEVDDDGRATGFVKFPGVLVSQNKRTALKLEFVDGELPEIGLGDRETDFAFMSLCKEAYVVPKRKVDAVDGSALAQRVIFHDGRLVQLPTPFVALVTFLWLPIGFALAVLRIGLTSRCPRKYMGMIYAILGVRRITKGKVPRKQDGRGLLFVCNHRTLVDPIFVGLAAERDVTGLTYSISRVSEVLSPIVTVRLTRDKQRDFTKMKSLLERGRDLCLCPEGTTCREPFLLRFSALFTELTHRIVPAAVKTRQSMFNGTAVRGWKGMDPFFFFMNPFPTYEVEFLEELPVEMSVQKGGKSSFETANFIQKMLGDKLGYECTTFTRKDKYLMLNGSDGTVPTK

SEQ ID NO: 165 - protein, 534 aa, Selaginella moellendorffii
MSLDGGKVTDSFLVDAPFEPVERCSSAGREKQTCVADFDGTLIRGRSSFPYFMLVALEGGGLIRSVILGLFAPLAWILYHFVSESAGIRLLIFISFAGMKAKQIESVSRAVLPKFYSEDVHSEAYRVFSSCGKRVVVTANPRIMVEHFAKTCLGADKVLGTEIEVTRSGYATGFLKRPGVLVGVNKRKAVRQEFGEHLPHVGIGDRATDFAFMALCKEAYVVPPSKVEALSRDKLVKPVVFHDGRLVQRPTPLTALVTFLWLPVSFVLAVFRIMVTVPCPREYVTIVYKLVGIRLIVKGPIPPPKKRGESGVLFVSSHRTLCDPVFVGVGARREVTALTYSISRVSEFLSPIKTVGLSRDRERDAAKIKALLQKGDLCICPEGTTCREPFLLRFSALFAELTDKIVPVALCTKGSTFHGTTVRGWKGLDPFFFFMNPFPTYEVTFLQQLPPELTVQQGGKSAIEVANHIQRVIADTLGFECTNFTRKDKYGMLAGNDGTVPERRRSGGGGGGAAKDLPEDEQAAQGQDQVNGCS

SEQ ID NO: 166 - protein, 497 aa, Oryza sativa
MVSRRFKPVEECSSDGRSEQTVAADFDGTLVRSRSAFPYYLLVALEAGSVLRAVVLLLSVPFVYVTYIFFSESLAISTLVYISVAGLKVRNIEMVARSVLPKFYAEDVHPESWRVFNSFGKRYIITASPRIMVEHFAKTFLGADKVVGTELEVGKNGKATGFMVKPGVLVGDHKRQAVVKELRDAVPDVGLGDRETDFDFMSICKEAYLVTSRKYSAVPKNQLLSPLILHDGRLVQRPTPLVALVTFLWMPFGFALALLRVYVNLPLPERIVFYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLNQLPKELTCSGGKSPIEVANYIQKTLSGQLGFECTAITRKEKYSILAGTDGRVPSKNKEKEKN

SEQ ID NO: 167 - protein, 506 aa, Oryza sativa
MAAAAAAGRRRFFPPVTAYDAAAGARRTVAADLDGTLLVSSSAFPYYFLVALEAGSYLRALALLLAAPWLLALYVGVSEAAAIALLVFITFAGLRVRDVEAVARAVLPRHYAAGVRADTWAVFHGCAERRVVVTASPAVMVGEFVREFLGAEVAGTELETFASGKRFTGRIKAVLVGEKKREVVERLFAGGDMPDVGLGDRESDHDFMAICKEAYMVPKNKRAPRAAADELLSRAIFHDGRLVRRPEPASALFALAYLPVGFAVALLRVFLNLPVPARLVRHTYRLTGIRLAVRGAPPPPPRPGTPGSLLVCNHRTALDPIIVSIALGRPVTCVTYSVSRLSTAISPIRAAALTRDRAADAARIAALLEEGDVVVCPEGTTCREPYLLRFSALFAELTARIVPVAVEARQGTYYGSTARGWKFLDPYFFYMNPRPGYEVTFLPALRPEETCVAGGRSAVEVANHVQRVIAKELGFQCTTLTRKDKYMKLAGNDGRVAAAADKPKAN

SEQ ID NO: 168 - protein, 515 aa, Zea mays
MAARFPPVSSYDASARVRRTAAADLDGTLLASSSAFPYYFLVALEAGSCARALLLLLAAPLLLALYTLVSEAAAIALLAFVTFAGLRVRDVEAVARGVLPRHYAAGVRADTWAVFRDCGAARRVVVTASPAVMVADFVREFLGAELAATELETCRALGDAWFTGRIKAVLVGERKAEVVRRLFAAGDLPDVGLGDRESDHDFMAICKEAYMVPPDRRAPRAAADALLSRAVFHDGRLVRRPDPAHALFALAYLPLGFLLALFRVLFNLAMPARLVRHTYRLTGIRLRVRGTPPPAPAPGAPGSLLVCNHRTALDPIIVSVALGRPVACVTYSVSRLSTAVSPVRAVALSRDRAADAARIAALLAEGDVVVCPEGTTCREPCLLRFSALFAELTDRIVPVALDARQGTYYGSTARGWKWLDPYFFYMNPRPGYDVTFLPPLRPEETCGAGGRSAVDVANHVQTLIAKELGFRCTKLTRKDKYMKLAGNDGTVGGRPENEKGAADDSAATATTKKLV

SEQ ID NO: 169 - protein, 500 aa, Zea mays
  misc_feature (92)..(92): Xaa can be any naturally occurring amino acid
MVASPRFKPIEECCSEGRSEQTVAADLDGTLLISRSAFPYYLLVALEAGSVLRAALLLLSVPFVYVTYAFFSESLAISTLVYISVAGLKVRXIEMVARSVLPRFYAGDVHPESWRVFSSFGRRYVVTASPRVMVEPFARAFLGADKVVGTELEVGRDGKATGFMARPGVLVGDHKKKAVVKELGDALPDVGMGDRETDFDFMSICKEAYLVTSRKYSPVPRNQLLSPLIVHDGRLVQRPTPLVALVTFLWMPFGFALALMRVYINLPLPERIVYYTYKLMGIRLVVKGTPPPPPKKGHPGVLFVCNHRTVLDPVEVAVALRRKVSCVTYSISKFSELISPIKAVALSRERDKDAENIRRLLEEGDLVICPEGTTCREPFLLRFSALFAELTDRIVPVAINTKETMFHGSTVRGFKLMDPYFFFMNPRPTYEITFLTQLPKDLTCSGGKSPIEVANYIQKTLSGQLGFECTSITRKEKYGMLAGTDGRVPSKNKEKEKDKN

SEQ ID NO: 170 - protein, 486 aa, Zea mays
MVSRRFKPIELCDSEGRSRQTVAADLDGTLLLSRSAFPYYLLIALEAGSLLRAVALLLSVPLVYLTYVTVSETLAVRAFIYVAMAGLEARDIEAVARSVLPSFYAGDVHPEGWRVFRSFGRRCVVTASPRLMVEPFAKAFLGADVVIGTEVEVAQSGKATGFVAGPGVLVGEHKRRAVAREFGDSLPDVGMGDRESDFDFMSICKEAYTVTRQKYRALPRDQLQGRAILHDGRLARRPTATNALLTFLWMPLGFALALVRAHLHLLLPVRALAYAYKLTGVKLVVRGNRPPPSKKKKGDQLGVLFVCNHRSTLDAVAVGVALGRKVRWVVTDGGAGASRFSEPVVSPIMTGVPLPVPTSLEGDADADAAPRIRRLLEEGDDVVVFPEGAICREPFLLRFGALFAEVTDRIVPVAIEPRESMFHGSTARGLRGMDPYFFFMNPRPTYEVTFLNQLPGELTCGGGRSPVEVASYVQEVLAAQLGFECT

SEQ ID NO: 171 - protein, 505 aa, Brassica napus
MSPAKKKSTSFPPISECKSGEYDSIAADLDGTLLLSRSSFPYFMLVAIEAGSLFRGLILLLSLPIVIIAYLFVSEALGIQILIYISFAGIKIRDIELVSRAVLPRFYAADVRKDSFEVFDKCKRKVVVTANPIVMVEPFVKDYLGGDKVLGTEIEVNPKTMKATGFVKKPGVLVGDLKRLAILKEFGDESPDLGLGDRTSDHDFMSICKEGYMVHETKSATTVPIERLKNRIIFHDGRLVQRPTPLNALIIYLWLPFGFMLSIFRVYFNLPLPERFVRYTYEILGIHLTIRGHRPPPPSPGTPGNLYVLNHRTALDPIIIAIALGRKISCVTYSVSRLSRMLSPIPAVALTRDRAADAARMRKLLEKGDLVICPEGTTCREPYLLRFSALFAELSDRIVPVAMNCKQGMFNGTTVRGVKFWDPYFFFMNPRPSYEATFLDRLPEEMTVNGGGKTPIEVANYVQKVIGGVLGFECTELTRKDKYLLLGGNDGKVESIKKTKDDKSS

SEQ ID NO: 172 - protein, 500 aa, Arabidopsis thaliana
MSPEKKSQNFPPITECRDGEYDSIAADLDGTLLLSRSSFPYFMLVAVEAGSLLRGLILLLSLPFVIISYLFVSESLGIQILIFISFAGLKIRDIELVSRAVLPRFYAADVRKDSFEVFDKCKRKVVVTANPIVMVEAFVKDYLGGDKVLGTEIEVNPKTNRATGFVKKPGVLVGDLKRLAILKEFGNESPDLGLGDRTSDHDFMSLCKKGYMVHATKSATTIPKERLKNRIVFHDGRLAQRPTPLNAIITYLWLPFGFILSIIRVYFNLPLPERFVRYTYEMLGIHLTIRGHRPPPPSPGTLGNLYVLNHRTALDPIIVAIALGRKICCVTYSVSRLSLMLSPIPAVALTRDRATDAANMRKLLEKGDLVICPEGTTCREEYLLRFSALFAELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESINNTKK

SEQ ID NO: 173 - protein, 514 aa, Physcomitrella patens
MQQLDPLTSFHCSESFEGVETCRVEGRANQSIVSDLDGTLLRSRSSFPYFMLLAFEAGSPLRSVVLLLISPVVWLVYNFVSEAAGIKMLIFVSLAGLKVSAVESVARGVLPKFYLEDMHSISYRVFTSCGKRYVVTANPRIIVEPFLKEYLDVEAVMGTELQISSGGYVTGFVTGPGVLVGAVKERAVKKYFGPDPPDVGLGDRQSDFLFMDLCKESYIVHSDKDVPAVSKEDFLKPLIFHDGRLVCRPTPLMSLIVMLWCPIGFVLAVVRMLIGIALPMWWALPLEAMLGVTVRVKGIPPTCPLRNKKRGVLFVCSHRTLLDPIFLSIAVRRKVTAVTYSISRLSEVLSPIRTVRLTRDRNTDANTMASLLEEGDLVVCPEGTTCREPYLLRFSSLFAELTDQIVPVTMNIKITMFHGTSARGWKGMDPFFFFMNPCPKYEVTFLDQLPHQLTCNGGKTSHEVANYIQRVLANSLGFQCTNLTRKDKYTVLAGNDGIVPDHTLRQRAGRMFGL

SEQ ID NO: 174 - protein, 501 aa, Physcomitrella patens
MKRDPFDTIDKCSDKGRSKQTVVSDLDGTLLRSRSSFPYFMLVAFEAGGVARAFVLLLCSPLCWLLYHCVSESIGIRLLIFVTFAGLKIGGIEAIARGTLPKFYAEDVHPDTWRIFSSFGERYILTATPRIMAETFAKTYLGVDGVLGTELHFTSGGIATGLLMNPGVLTGRNKEIVLRQEFQGLNLPDVGLGDRPSDHNFMSICKEGYIVPPSNTILAASKESLMNLLVFHDGRLIQRPTAGIALIILLWYPIGAVLAVLRILAGILLPFHLLKLVYKFLGVGVVVRGTPPPEPKDGPGRGGYLYVCSHRTLLDPVMVGVALKRRVTAVTYSISRLSEVLSPIKTVALKRNREKDAAKIRSLLREGDLAICPEGTTCREPYLLRFSALFAELSNQLVPVAMNTRMSMFHGTTAQGWKCLDPFYFFMNPNPIYEVTFLNELPVELTCAGGKSSYEVANHIQQLLSQTLGFECTNYTRKDKYGVLCGNDGSIPLKSQDSFGS

SEQ ID NO: 175 - protein, 517 aa, Physcomitrella patens
METQEPDPVTSFHCSENYDEVENCRVEGRANQSIVSDLDGTLLRSRSSFPYFMLLAFEAGSPLRFIILLLVSPIVWFVYNFISEVVGIKMLIFISLAGLKVSAIESVARGVLPKFFLEDMHSISYRVFISCEKRYVVTANPRIIVEPFLKEYLDVDAVMGTELQISSGGYATGFVTGPGVLVGTAKQRAVKKYFGSDQPDLGLGDRTSDFAFMDLCKEAYIVPSYKEVPSVTKKDYLKPLIFHDGRLVCRPTPLMALAVTLWCPIGFVLAIIRMFIGIMLPMWWALPLEAMLGVTVRIKGIPPTCPLRSKKRGVLFVCSHRTLLDPIFLSIAVRRKVTAVTYSISRLSEVLAPIRTVRLTRDRNTDASTMASLLDEGDLVVCPEGTTCREPYLLRFSSLFAELTDQIVPVTMNIKISMFHGTSARGWKGMDPFFFFMNPRPKYEVTFLDQLPHQLTCNGGKTSHEVANYIQRVLANSLGFQCTNLTRKDKYRVLAGNDGIVPDRSLRQRASRIFGLQ

SEQ ID NO: 176 - protein, 504 aa, Physcomitrella patens
MEVTKLKEAGNYSFAEVKSCSSGNDRRSQTVVADLDGTLIRGRSAFPYFFLVAFEAGSYFRALLLSLMAPLIGFLYYFVDEASGIHLMIFLSFAGLKIKDIEGVARAVLTKFYADDLHPETWRVFSSFGKRVVLTANPRVMVEPFLKEVLGADEVMGTEIEVNKKGRATGRLLKPGVLVGTHKEEALKRCNIGGERPHVGLGDRVTDFPFMAYCKEGYVVPKTKVPAVKKQDMPKQLIFHDGRLVQLPTPRNAFKVLAWMPIGLLLSIVRVTMGVWVPIRLMPLCYKLTGINLVVKGNIPEKPKNGEPGRLFVCNHRTLLDPVIIALALGRPVPAVTYSISKVSEFLSPMPTIGLCRDREKDSANMRRVLKEGELTLCPEGTTCREPFLLRFSALFAELSDRIVPVAVKINMNMFHGTTARGNKAMDPFFAYMNPRPTIELKFLDEIPKNMTCGSGKSSIEVANYIQHLLAGELGYDCTDFTRKDKYRLLAGNDGIVPVKEKTR

SEQ ID NO: 177 - protein, 529 aa, Physcomitrella patens
MEIPGVFDANLFCAESFPEVETCKVEGREKQTIISDLDGTLLRSRSSFPYFMLIAFDAGSPLRFIVLLLASPIIWLVYNFFSEAAGTKLLIFIACAGLKASDIESVARGVLPKFYLEDMHSVSYSIFVSCGKRYVVTANPRIMVESFLKEYMGVEAVIGTELHITKSGYATGLVMGAGVIVGANKTRAVKKYFGDDLPDIALGDRASDFPFMALCKEAYLVPSFKPVEPVAKADYLKPLIFHDGRLVCRPTPLMSLVIILWSPIGLILALIRMVFGTVLPMWYALPLEAMLGVSIRVKGIPPSCPQTSGRRGVLFVCSHRTLLDPIFLSIACRRQVTAVTYSISKVSEILSPIPTVRLTRCRKTDAETMTKLLNEGDLAVCPEGTTCREPYLLRFSSLFAELADQIIPVTMNVKTTMFHGTTARGWKALDPFIFLMNPSPRYELEFLDQLPHEMTCSGGKSSHEVANYIQRVLAASLGFKCTNLTRRDKYRILAGNDGVVPASHFLKQRSRIFACLPSRNSERGQRSDP

SEQ ID NO: 178 - protein, 503 aa, Vitis vinifera
MAVTTFPTVDQCQSIGREKHTVVADMDGTLLIGRSSFPYFALVAFEGGGVLRLLFLLLASPLAGLLYYFVSESAGIQILIFVTFAGMKVSDIESVARAVLPKFYLSDLHPESWRVFSSCGKRCVLTANPRIMVEAFLKDFLGADLVLGTEIATYKGRATGFVCDPGVLVGKNKAYALNKTFGETQPEIGLGDRHTDFPFMASCKEGYIVAAKPEVKAVTSDKLPKPIIFHDSRLVQKPTPLTALLTLLWIPIGFALACLRIAAGSLLPMRIVYHAFWALGVRVSVKGSPPPVAKKSIGQSGVLFICSHRTLLDPIFLSAALGRPIPAVTYSVSRLSEFISPIKTIRLSRDRVKDAAMIKKLLEEGDLAICPEGTTCREPFLLRFSALFAELTDQLVPVAMMNRMSMFHGTTARGWKGMDPFFFFMNPSPAYEVTFLNKLPLELTCSSGKSSHEVANYMQRVIAATLSYECTSFTRKDKYRALAGNDGTVPKKPLLYPDKVMGC

SEQ ID NO: 179 - protein, 501 aa, Vitis vinifera
MSPPPKRARKFPSITTYAGGDHRSIAADLDGTLLVSRSSFPYFMLVAVEAGSLLRGLFLLLSLPIVIVAYLFISEEIGIQILIFISFSGLKIRDIELASQAVLPRFYANDVRRESWEVFEKCERKVVVTANPTLMVEPFVRDFLGGTKVLGTEIEVNPKTKKATGFVKKPGVLVGDRKRLALLKEFGDELPDIGIGDRESDHDFMSICKEGYMVLPSKSATPVPPNRLKTPIIFHDGRFVQPPTPLTALIIYLWLPFGFALSIFRVYFNLPLPERIVRYTYPMLGINLVIRGNPPPPPSPGSPGNLYVCNHRTALDPIVIAIALRRKVSCVTYSVSRLSRFLSPIPAVALTRDRAADAARISSILQKGDLVVCPEGTTCREPYLLRFSALFAELSDRIVPVAVNVKQNMFHGTTVRGVKFWDAYFYFMNPRPTYEITFLDRLPEEMTCKAGGKSAIEVANHVQKVLGGVLGFECTGLTRKDKYMLLGGNDGKVESMYNAKK

SEQ ID NO: 180 - protein, 510 aa, Vitis vinifera
MTKSNLHSPPTSLTIDQCTSIGREKETVVADMDGTLLRGRSSFPYFALVAFEVGGIFRLLLLLLCSPLAGVLYYFISEPAGIQVLIFATFVGMKVSDIESVARAVLPKFYASDLHPEAWRVFSSCGKRCVLTANPRIMVEAFLKDFLGADMVLGTEVDTYKGRATGLVRGGGVLVGKRKAEALRNAFSETSLPEIGLGDRETDYPFMSLCKESYIVPAKPEVEAVSHDKLPKPIVFHDGRLVQKPTPFMALLTILWIPVGFLLACLRIAAGALLPMPLVYYAFWALGVRVYIKGNPPPPAKKSIGQSGVLFICSHRTLLDPIFLSAALGRPIPAVTYSLSRLSEFISPIKTVRLSRDRATDAAMIKKLLEAGDLAICPEGTTCREPFLLRFSALFSELTDELVPVAMANRMTMFHGTTARGWKGMDPFYYFMNPSPAYEVNFLNKLPHELTCGAGKSSHDVANYIQRMIAASLSYECTNFTRKDKYRALAGNDGTVVEKPKVDANKVMGC

SEQ ID NO: 181 - protein, 499 aa, Vitis vinifera
MGAQRHFQPISKCSSDGRANQTVAADLDGTLLVSRSAFPYFMLVALEAGSLVRAILLLASVPLVYFIYLFISESLAIKIFIYMAFAGLKVREIELVSRSVLPKFYAEDVHPESWRVFNSFGKRYIITANPRIMVEPFVKTYMGADKVLGTELEVSNSGRATGFVKKPGVLVGEHKKAAVQQEFGMNLPDVGLGDRDTDHDFMSLCKEGYMVPRTKCEPLPRNKLLSPVIFHEGRLVQRPTPVAALLTFLWMPIGIILSILRVYLNIPLPERIVRYNYKILGIKLIVKGTPPPPPKGGQSGVLFVCNHRTVLDPVVTAVALGRKISCVTYSISKFSELISPIKAVALSREREKDAANIKRLLEEGDLVICPEGTTCREPFLLRFSALFAELTDRIVPVAINTKQSVFYGTSTRGYKLLDPYFVFMNPMPTYEITFLNQLPAELTCKGGKSPIEVANYIQRVLAGTLGFECTNLTRKDKYATLAGTDGSVPFKNEKEKEKA

SEQ ID NO: 182 - protein, 497 aa, Populus trichocarpa
MVMGAHRHFEPIAKCSTEGRSNQTVAADLDGTLLVSRSAFPYFLLVAIEAGSLLRGLILLASVPFVYFTYLFISEAMAIKTFIFIAFAGLKIRDIELVSRSVLPKFYADDVHPETWRVFNSFGKRYIVTANPRIMVEPFVKTFLGADKVLGTELEATKSGRATGFIKKPGVLVGDHKRDALLKEFGTNLPDLGLGDRETDHDFMSICKEGYMVPGTKCEPLARNKLLSPVIFHDGRLVQRPTPLAALLTFLWMPIGIILSILRVYLNIPLPERLAWYTYKLLGIRVIVKGTPPPPPGKGHSGVLFVCNHRTVLDPVVTAVALGRKISCVTYSISKFTEIISPIKAVALSRERDKDAANIKRLLEEGDLVICPEGTTCREPFLLRFSALFAELTDRIVPVAINTKQSVFHGTTVRGHKLLDPYFVFMNPMPTYEVTFLNQLPKELTCKGGKSAIEVANYIQRVLAGTLGFECTNLTRKDKYAKLAGTDGRVLSKKENA

SEQ ID NO: 183 - protein, 501 aa, Populus trichocarpa
MVSFPTVDKCASIGREKHSVVADMDGTLLRGRSSFPYFALLAFEAGGIFRLLFLLLNSPLAGLLYYFVSESAGIKVLIFATCAGMKLSDIESVARAVLPKFYSSDLHSESWRVFSSCGKRCVLTANPRIMVEAFLKDFLGADLVLGTEILTYKGRATGFVQSPGVLVGKNKADALKKAFGKTQPEIGLGDRHTDAPFMALCKEGYIVPPKPEVEAVTTDKLPKPVIFHDGRLVQKPTPLSALLIILWIPIGFILACLRIAAGSLLPMPMVYYAFWALGVRVNIKGTPPPPAKKSIGQSGVLFVCSHRTLLDPIFLSTALGRPIPAVTYSLSRLSEIISPIKTVRLSRDRAADASMIKKLLEEGDLAICPERTTCREPFLLRFSALFAELTDELVPVAMANRMSMFHGTTARGWKGMDPFYFFMNPSPAYEVTFLNKLPLELTLSGGKSSHEVANYIQRVIAATLSYECTSFTRRDKYRALAGNDGNVVEKTKVQANKVMGC

SEQ ID NO: 184 - protein, 501 aa, Populus trichocarpa
MDSFPTVDKCASIGREKHTVVADMDGTLLRGRSSFPYFALLAFEAGGIFRLIFLLLASPLAGLLYYFVSESAGIKVLIFATCAGMKVSDIESVARAVLPKFYSSDLHSESWRVFSSCGKRCVLTANPRIMVEAFLKDFLGADLVLGTEMSTYKGRATGFVQSPGVLVGKNKADALKKAFGMTQPEIGLGDRHTDAPFMALCKEGYIVPPKPEVEAVTTDKLPKPVIFHDGRLVQKPTPLSALLTILWIPIGFILACLRIAAGSLLPMPMVYYAFWALGVRVIIKGTPPPPAKKSIGQSGVLFICSHRTLLDPIFLSTALGRPIPAVTYSVSRLSEIISPIKTVRLSRDRATDASMIKKLLEEGDLAICPEGTTCREPFLLRFSALFAELTDQLVPVAVVNRMSMFHGTTARGWKGMDPFYFFMNPSPAYEVTFLNRLPQELTCTGGKSSHEVANYIQRVIAATLSYECTSFTRRDKYRALAGNDGTVVEKTKLQANKVMGC

SEQ ID NO: 185 - protein, 500 aa, Populus trichocarpa
MVMGAHRHFEPIAKCSTEGRSNQTVAADLDGTLLVSRSAFPYFLLVAIEAGSLLRGLILLSSVPFVYFTYLIISEEMAIKTFIFIAFAGLKIRDIELVSRSVLPKFYADDVHPETWRVFNSFGKRYIVTANPRIMVEPFAKNFLGADKVLGTEIQATKSGRATGFVKKPGVLVGDHKRNALLKEFGTSLPDLGLGDRETDHDFMSICKEGYIVPRSKCEPLPRNKLLSPVIFHEGRLVQRPTPLVALLTFLWMPIGIILSVLRVYLNIPLPERIAWYNYKLLGIRVVVKGNPPPPPRKGQSGVLFVCNHRTVLDPVVTAVALRRKISCVTYSISKFTEIISPIKAVALSRERDRDAANIKRLLEEGDLVICPEGTTCREPFLLRFSALFAELTDRIVPVAINTKQSVFNGTTVRGHKLLDPYFVFMNPMPTYEITFLNQLPTELTCKGGKSSIEVANYIQRVLAGTLGFECTNLTRKDKYAILAGTDGRVATKKEKASEN

SEQ ID NO: 186 - protein, 524 aa, Sorghum bicolor
MERPSPTCLAANGPRRKARTIPFPPPPADLRTGRLRSRQTVAADLDGTLLLSRSAFPYYLLVALEAGSLLRAVALLMSVPFVYLTYVTVSETLAVRAFLYVAVAGLDVSDIEAVARTVLPRFYAGDVHPEGWRVFRSFGRRCVVTASPRVMVEPFARAFLGADVVIGTEMEVGASGKATGFVAGPGVLVGEHKRRAVVREFGDALPDVGMGDRESDFDFMAICKEAYMVTRQKYRALPREQLQSRVILHDGRLARRPTATNTLLTLLWMPLGFALALARVHLHLLLPARALSYAYKLMGVKLVVRGNRPPPPPPSKKGGGPGVLFVCNHRTTLDPVAVAVALGRKVRWVVTDGASSRFSEAVSPVMTGVALPVPVPSRESDDDADAAARIRRLLEEGDDVVIFPEGTICREPFLLRFGALFAEVTDRIVPVAIGAREGMFHGSTARGLRRMDPYFFFMNPRPTYEVTFLNQLPRELTCGGGRSPVEVANYVQEVLAAQLGFDCTCTSKQAKTGWSPAAPTVAWR

SEQ ID NO: 187 - protein, 503 aa, Sorghum bicolor
MVASYRSRRFKPIEECCSEGRSEQTVAADLDGTLLISRSAFPYYLLVALEAGSVLRAVLLLLSVPFVYVTYIFFSESLAISTLVYISVAGLKVRSIEMVARSVLPRFYAGDVHPESWRVFNSFGKRYIITASPRIMVEPFARAFLGADKVVGTELEVGKNGKATGFMVKPGVLVGDHKKKAVVKELGDAVPDVGMGDRETDFDFMSICKEAYLVTSRKYSPVGKNQLLSPLILHDGRLVQRPTPLVALVTFLWMPFGFALALMRVYINLPLPERIVYYTYKLMGIRLIVKGNPPPPPKKGHPGVLFVCNHRTVLDPVEVAVALRRKVSCVTYSISKFSELISPIKAVALSREREKDAENIRRLLEEGDLVICPEGTTCREPFLLRFSALFAELTDRIVPVAINTKESMFHGSTVRGFKLMDPYFFFMNPRPTYEITFLTQLPKDLTCSGGKSPIEVANYIQKTLSGQLGFECTTITRKEKYGILAGTDGRVPSKNKDKEKEKN

SEQ ID NO: 188 - protein, 505 aa, Sorghum bicolor
MAASPFPTVEKCSSTDRSGDTVVADLDGTLLCGRSSFPYFAHMAFETGGVLRLLLLIALAPLAGLLYYFVSEPAGIQVLIFASMAGARVADIEAVARAVLPKFYCADLHPESWRVFSACGRRCVLTANPRIMVEAFLKEYVGTDVVVGTELVVWRGRATGLVRSPGVLVGEQKADALRRTFGDDVAPEVGLGDRKTDYPFMRLCKEGYVVPATPKLKPVPRENLPKPVVFHDGRLVQKPSPALALLTVLWIPIGFLLACLRIAAGALLPMRMVYHAFRALGVRVTIRGNPPPPASRETGQTGVLFICSHRTLLDPIFLSTALGRPITAVTYSVSRLSEILSPIRTVRLTRDRAADAAMIRRLLTEGDLVICPEGTTCREPFLLRFSALFAELTDEIVPVAMENQMSMFHGTTARGWKGLDPFYFFMNPSPGYVVTFLNKLPAELTCNGGGKSSHEVANYIQRLIASTLSYECTNFTRKDKYKALAGNDGTVVSKPNIDKNKVMGC

SEQ ID NO: 189 - protein, 518 aa, Sorghum bicolor
MEEAVEAVVAAGVEPFPTVDKCDASGLGAHSSVVADLDGTLLRSRSAFPYYALVAFETGGVPRLLLLLLLSPLAALLRFLASESACLRVLVFGATAGARVRDVESAARAVLPRFYAADVHPAAWRVFSACSRRRVVLTATPRLFAEPFLRDCLGADAVAGTELATWRGRATGLVDARRGGVLVGRSKAQALREILAADGGDAPDVGLGDSRSDYPFMSMCKEAYIVPRAPVEPALPMDQLPRPVIFHDGRLVRRPTPLVALVVVLWFPVGLALACLRIAAGALLPMPLVYYAFWALGVRVVVRGAPPPPRAERATGRRGVLFACSHRTLLDPIFLSTALGRPVAAVTYSLSRLSEFLSPIRTVRLSRDRATDAAMIRDLLAEGDLVICPEGTTCREPFLLRFSALFAELTSEVVPVAMENRMSMFHGTTARGWKGMDPFYFFMNPSPAYVVTFLNKLPPELTCAGGRTSHEVANYIQRLIAATLSYECTSLTRKDKYRALAGNDGVVATPKPPPTVAS

SEQ ID NO: 190 - protein, 501 aa, Ricinus communis
MPAMKQAQKFPSITSCSGTSYESIAADLDGTLLVSSSSFPYFMLVAVEAGSLLRGLVLLLSLPFIIISYFFISEAIGIQILIFISFAGLKIRDIELVSRAVLPRFYAADVRKESYEVFDRCKRKVVVTANPTIMVEPFVKDFLGGDKVLGTEIEVNPKTKRATGFVKKPGVLVGKWKKLAILKEFGEDAPDLGIGDRKTDHDFMSICKEGYMVYHSKKAATPLPRDRLKSPIIFHDGRFVQRPDPLNALATYLWLPFGFMLSIFRVYFNLPLPERIVRYTYEMLGIHLVIRGYPPPAPSRGTPGNLYVCNHRTALDPIVIAIALGRKVSCVTYSVSRLSRFLSPIPAIALTRDRAADAERITALLQKGDLVVCPEGTTCREQFLLRFSALFAEMSDRIVPVAVNCKQSMFYGTTVRGVKFWDPYFFFMNPRPTYEVTFLDRLPEEMTVKAGGKSSIEVANYVQKVLGDVLGFQCTGLTRKDKYLLLGGNDGKVESMYNSKK

SEQ ID NO: 191 - protein, 512 aa, Ricinus communis
MANPKETYAPFSSFPNIEKCTSVGRQNDTVVTDMDGTLLCGRSPFPYFALVAYEASGILRLLFLLLGSPIAGILRYFISESAGIRVLVFATFAGMRVSDIESVARAVLPKFYSSDLHPETWRVFSSCGKKCVITENPRIMVEAFLKEFVGADMVIGTEIVVHKGRATGFIRSPGVLVGQNKADALKMAFYDAPVPNIGIGDRRTDRPFMKLCKESYIVPSNSQVEPVGPKKLPKPIVFHDGRLVQKPTHLIALATLLWIPVGFILACLRLAAGALLPMPLVYYALWALGVRIHIKGTPPPPAKKSTGQAGVLFVCSHRTLLDPVFLSIALGRPIPAVTYSLSRLSEFISPIKTVRLTRDRVTDANMIKELLQEGDLVICPEGTTCREPFLLRFSALFAELTDELVPVAMANKMTMFHGTTARGWKGMDPFYFLMNPSPAYEVTFLNKLPYNLTCGAGKSSHSVANYIQRTIAATLSYQCTSFTRKDKYRALAGNDGTVVEEPKQARDEVMDS

SEQ ID NO: 192 - protein, 504 aa, Ricinus communis
MVMVDSFPEVSKCASKGREKHTVVADMDGTLFIGRSSFPYFALIAFEAGGIFRLLFLLLASPLAALLYYFVSESAGIQVLIFASFAGMKVSDIESVARAVLPKFYSSDLHPESWRVFSSCGKRCVLTANPRIMVEAFLKDFLGADLVFGTEISTYKGRATGFVRTPGVLVGKNKANALKKAFGDARPEVGLGDRRTDAPFMALCKEGYLVPPKPEVRAVTGDKLPKPIVFHDGRLVQKPTPLMALLIILWIPIGFILACLRIAAGSLLPMPMVYYAFLALGVRVTVKGNPPPPAKKSTGQSGVLFVCSHRTLLDPIFLSTALGRPIAAVTYSVSRLSEIISPIKTVRLSRDRATDAAMIKKLLVEGDLAICPEGTTCREPFLLRFSALFAELTDQIVPVAMVNRMSMFHGTTARGWKGMDPFYFFMNPSPAYEVTFLSKLPQELTCSSGKSSHEVANYIQRVIAATLSYECTGFTRKDKYRALAGNDGSVVEKPKLEANKVMGC

SEQ ID NO: 193 - protein, 498 aa, Arabidopsis lyrata
MSPAKKSGNFPPITECRDGEYDSIAADLDGTLLLSRSSFPYFMLVAVEAGSLFRGLILLLSLPIVIISYLFVSESLGIQILIFISFAGLKIRDIELVSRAVLPRFYAADVRKDSFDVFDKCKRKVVVTANPIVMVEAFVKDYLGGDKVLGTEIEVNPKSNRATGFVKKPGVLVGDLKRLAILKEFGDESPDLGLGDRTSDHDFMSLCKKGYMVHACKSATTIPKERLKNRIVFHDGRLAQRPTPLNAIVTYLWLPFGFILSIIRVYFNLPLPERFVRYTYEILGIHLTIRGHRPPPPSPGTLGNLYVLNHRTALDPIIVAIALGRKICCVTYSVSRLSLMLSPIPAVALTRDRVTDAANMRKLLEKGDLVICPEGTTCREEYLLRFSALFSELSDRIVPVAMNCKQGMFNGTTVRGVKFWDPYFFFMNPRPSYEATFLDRLPEEMTVNGGGKTPIEVANYVQKVIGAVLGFECTELTRKDKYLLLGGNDGKVESIMLG

SEQ ID NO: 194 - protein, 501 aa, Arabidopsis lyrata
MGAQEKRRRFEPISKCDVKDRSNHTVAADLDGTLLISRSAFPYYFLVALEAGGLLRALILLVSVPFVYLTYLTVSETLAINVFVFITFAGLKIRDVELVVRSVLPRFYAEDVRPDTWRIFNTFGKRYIVTASPRIMVEPFVKTYLGVDKVLGTELEVSKSGRATGFTRKPGILVGQHKREVVLREFGSLASDLPDLGLGDSKTDYDFMSICKEGYMVPRTKCEPLPRNKLLSPIIFHEGRLVQRPTPLVALLTLLWLPIGFLLSLIRVYTNIPLPERIARYNYKLTGIKLIVNGHPPPPPKPGQPGHLLVCNHRTVLDPVVTAVALGRKISCVTYSISKFSELISPIKAVALTRQREKDAANIKRLLEEGDLVICPEGTTCREPFLLRFSALFAELTDRIVPVAINTKQSMFNGTTTRGYKLLDPYFAFMNPRPTYEITFLKQIPAELTCKGGKSPIEVANYIQRVLGGTLGFECTNFTRKDKYAMLAGTDGRVPVKKEKT

SEQ ID NO: 195 - protein, 502 aa, Vernicia fordii
MSQTKPAPKFPSITSCTGSAYQSIAADLDGTLLVSSSSFPYFMLVAVEAGSLLRGLVSLLSLPLVIISYFFISEAVGIQILIYISFAGLKIRDIELVSRAVLPRFYAADVRKESFEVFDKCKRKVVVTANPTIMVEPFVKDFLGGDKVLGTEIEVNPKTKRATGFVKNPGVLVGKWKKLSILKEFGEESPDLGIGDRKTDHDFMSICKEGYMVQRSKSATPIPLDRLKSRIIFHDGRFVQRPDPLNALVTYLWLPFGFILSIIRVYFNLPLPERIVRYTYEMLGIHLVIRGNPPPAPSPGTPGNLYVCNHRSALDPIVIAIALGRKVSCVTYSVSRLSRFLSPIPAIALTRDRAADAARISELLQKGDLVVCPEGTTCREPFLLRFSALFAEMSDRIVPVAVNCKQNMFYGTTVRGVKFWDPYYFFMNPRPTYEVTFLDRLPEEMTAKAGGKSSIEVANYVQKVLGDVLGFECTGLTRKDKYMLLGGNDGKVESMYNTKKAG

SEQ ID NO: 196 - protein, 514 aa, Oryza sativa
MGDATMIASPFPAVEKCSSKDRGGDTIVADLDGTLLCGRSSFPYFAHMAFETGGVLRLLALILLAPLAGVLYYLVSESAGIQVLIFASMAGARVADVEAVARAVLPKFYCSDIHPESWRVFSACGRRCVLTANPRMMVEAFLKEYLGADIVVGTELVVWRGRATGLVRSPGVLVGENKAAALREAFGDASPEIGIGDRRTDYPFMRLCKEGYVVPVSPTPRPVPREELPKPVVFHDGRLVQKPSPALALLTVLWIPIGFVLACLRIAAGALLPMRVVYHAFRALGVRVTVKGTPPPPASRETGQSGVLFICSHRTLLDPIFLSTALGRPITAVTYSVSRLSEILSPIRTVRLTRDRAADAAMIRRLLAEGDLVICPEGTTCREPFLLRFSALFAELTDEIVPVAMENQMSMFHGTTARGWKALDPFYFFMNPSPGYVVTFLSKLPGELTCNGGGGGGGGRSSHEVANYIQRLIASTLSYECTSFTRKDKYRALAGNDGTVVSKPNIDEKKAMGC

SEQ ID NO: 197 - protein, 503 aa, Brassica napus
MSPAKKKSRSFPPISECKRGEYDSIAADLDGTMLLSRSSFPYFMLVAIEAGSLFRGLILLLSLPIVIIAYLFVSEALGIQILIYISFAGIKIRDIELVSRAVLPRFYAADVRKDSFEVFDKCKRKVVVTANPIVMVEPFVKDYLGGDKVLGTEIEVNPKTMKATGFVKKPGVLVGDLKRLAILKEFGEESPDLGLGDRTSDHDFMSICKEGYMVHESKSATTVPIERLKNRIIFHDGRLVQRPTPLNAIIIYLWLPFGFMLSIFRVYFNLPLPERFVRYTYEILGIHLTIRGHRPPPPSPGTPGNLYVLNHRTALDPIIIAIALGRKISCVTYSVSRLSRMLSPIPAVALTRDRAADAARMRKLLEKGDLVICPEGTTCREPYLLRFSALFAELSDRIVPVAMNCKQGMFNGTTVRGVKFWDPYFFFMNPRPSYEATFLDRLPEEWTVNGGGKTPIEVANYVQKVIGGVLGFECTELTRKDKYLLLGGNDGKVESINKSKAKE

SEQ ID NO: 198 - protein, 500 aa, Populus trichocarpa
MSPTKPAKKFPPITACNGTTHQSIAADLDGTLLVSSSSFPYFMIVAVEAGSLFRGLVLLLSLPIVIVSYLFISEALGIQMLIFISMSGLKIRDIELVSRAVLPRFYAADVRSESFEVFDRCKRKVVVTANPTIMVEPFVKDFLGGDKVLGTEIEVNPKTKRATGFVKKPGVLVGKWKELAVLKEFGEEAPDLGIGDRKTDHDFMSLCKEGYMVHRSKSATPLPRDRLKNRIIFHDGRLVQRPDPLNALITYIWLPFGFILSIIRVYFNLPLPERIVRYTYEMLGIHLVIRGTPPPAPSPGTPGNLYVCNHRTALDPIVIAIALGRKVSCVTYSVSRLSRFLSPIPAIALTRDRAADAARISSILQKGDLVVCPEGTTCREEFLLRFSALFAELSDRIVPVAVNCKQNMFYGTTVRGVKFWDPYFFFMNPRPTYEVTFLDRLPEEMTVKAGGKSSIEVANYVQKVLGEVLGFENTGLTRKDKYLLLGGNDGKVESMHNAKK

SEQ ID NO: 199 - protein, 518 aa, Sorghum bicolor
MAPAASARFPPVSSYDASARTRRTAAADLDGTLLASSSAFPYYFLVALEAGSCLRAAALLLVAPLLLALYTLVSEAAAIALLAFVTFAGLRVRDVEAVARGVLPRHYAAGVRADTWTVFRGCGEGRRVVVTASPAVMVGEFVREFLGAEVAGTELETFSAFGAARFTGRIKAVLVGERKAEVVRRLFAGGEMPDVGLGDRESDHDFMAICKEAYMVPPDKRAARAAADTLLSRSVFHDGRLVQRPDPAQALFALAYLPLGFLLALFRVFFNLMMPLRLVRHTYRLTGIRLRVRGTPPPPPAPGAPGSLLVCNHRTALDPIILSVALGRPVSCVTYSASRLSTAISPIRAVALSRDRATDAARMAALLAEGDVVVCPEGTTCREPCLLRFSALFAELTDRIVPVAMEARQGTYYGSTARGWKWLDPYFFYMNPRPGYDVTFLPPLRPEETCGAGGRSAVDVANHVQRVIAKELGFQCTTLTRKDKYMKLAGNDGSVAARAKKDAADDNAATVTTTKKFV

SEQ ID NO: 200 - protein, 293 aa, Ricinus communis
MSICKEGYMVPRTKCEPLPRNKLLSPVIFHEGRLVQRPTPLVALLTFLWMPIGIILSILRVYLNIPLPERIAYYNYKILGIKVIVKGTPPPAPRKGQSGVLFVCNHRTVLDPVVTAVALGRKISCVTYSISKFTEIISPIKAVALSREREKDAANIKRLLEEGDLVICPEGTTCREPFLLRFSALFAELTDRIVPVAINTKQTVFHGTTVRGHKLLDPYFVFMNPMPTYEITFLNQLPIELTCKGGKSSIEVANYIQRVLAGTLGFECTNLTRKDKYAILAGTDGRVPSKKEK

SEQ ID NO: 201 - protein, 502 aa, Arabidopsis lyrata
MSPAKKSRSFPPISECKSREYDSIAADLDGTLLLSRSSFPYFMLVAIEAGSLFRGLILLLSLPIVIIAYLFVSESLGIQILIYISFAGIKIKNIELVSRAVLPRFYAADVRKDSFEVFDKCKRKVVVTANPIVMVEPFVKDYLGGEKVLGTEIEVNPKTMKATGFVKKPGVLVGDLKRLAILKEFGEESPDIGLGDRTSDHDFMSICKEGYMVHETKSATTVPIERLKNRIIFHDGRLVQRPTPLNALIIYLWLPFGFMLSIFRVYFNLPLPERFVRYTYEILGIHLTIRGHRPPPPSPGKPGNLYVLNHRTALDPIIIAIALGRKITCVTYSVSRLSLMLSPIPAVALTRDRVADAARMRQLLEKGDLVICPEGTTCREPYLLRFSALFAELSDRIVPVAMNCKQGMFNGTTVRGVKFWDPYFFFMNPRPSYEATFLDRLPEEMTVNGGGKTPFEVANYVQKVIGGVLGFECTELTRKDKYLLLGGNDGKVESINKTKSMD

SEQ ID NO: 202 - protein, 585 aa, Arabidopsis thaliana
MVLPELLVILAEWVLYRLLAKSCYRAARKLRGYGFQLKNLLSLSKTQSLHNNSQHHLHNHHQQNHPNQTLQDSLDPLFPSLTKYQELLLDKNRACSVSSDHYRDTFFCDIDGVLLRQHSSKHFHTFFPYFMLVAFEGGSIIRAILLLLSCSFLWTLQQETKLRVLSFITFSGLRVKDMDNVSRSVLPKFFLENLNIQVYDIWARTEYSKVVFTSLPQVLVERFLREHLNADDVIGTKLQEIKVMGRKFYTGLASGSGFVLKHKSAEDYFFDSKKKPALGIGSSSSPQDHIFISICKEAYFWNEEESMSKNNALPRERYPKPLIFHDGRLAFLPTPLATLAMFIWLPIGFLLAVFRISVGVFLPYHVANFLASMSGVRITFKTHNLNNGRPEKGNSGVLYVCNHRTLLDPVFLTTSLGKPLTAVTYSLSKFSEFIAPLKTVSLKRDRKKDGEAMQRLLSKGDLVVCPEGTTCREPYLLRFSPLFAELTEDIVPVAVDARVSMFYGTTASGLKCLDPIFFLMNPRPVYCLEILKKLPKEMTCAGGKSSFEVANFIQGELARVLGFECTNLTRRDKYLVLAGNEGIVR

SEQ ID NO: 203 - protein, 520 aa, Arabidopsis thaliana
MSAKISIFQALVFLFYRFILRRYRNSKPKYQNGPSSLLQSDLSRHTLIFNVEGALLKSDSLFPYFMLVAFEAGGVIRSFLLFILYPLISLMSHEMGVKVMVMVSFFGIKKEGFRAGRAVLPKYFLEDVGLEMFEVLKRGGKKIGVSDDLPQVMIEGFLRDYLEIDVVVGREMKVVGGYYLGIMEDKTKHDLVFDELVRKERLNTGRVIGITSFNTSLHRYLFSQFCQEIYFVKKSDKRSWQTLPRSQYPKPLIFHDGRLAIKPTLMNTLVLFMWGPFAAAAAAARLFVSLCIPYSLSIPILAFSGCRLTVTNDYVSSQKQKPSQRKGCLFVCNHRTLLDPLYVAFALRKKNIKTVTYSLSRVSEILAPIKTVRLTRDRVSDGQAMEKLLTEGDLVVCPEGTTCREPYLLRFSPLFTEVSDVIVPVAVTVHVTFFYGTTASGLKALDPLFFLLDPYPTYTIQFLDPVSGATCQDPDGKLKFEVANNVQSDIGKALDFECTSLTRKDKYLILAGNNGVVKKN

SEQ ID NO: 204 - DNA, 1330 bp, Arabidopsis thaliana
agttaaaagattggttatttgggctctgcactcaagtgagagagaagatagatagatctgagtagaatcttcgattcattattcgttgtcgtcgttcatctgtgagaagcggacaaaccaaagaatccaccggagctagtgatatgggtggttccagagagttccgagctgaggaacattcaaatcaattccactctatcatcgccatggccatctggcttggcgccattcacttcaacgtcgctcttgttctctgttctctcattttccttcctccttctctatctctcatggtcttgggcttgctctctctgtttatctttatcccaatcgatcatcgtagcaaatatggtcgtaagctcgctaggtacatatgcaagcacgcgtgtaattatttccccgtctctctgtacgtcgaggattacgaagctttccagcctaatcgtgcctatgtctttggttatgaaccacattcggtgctaccgattggagttgttgctctttgtgatctcacagggtttatgcctattcctaacattaaagttcttgcaagtagtgctatattctacactccctttctaaggcatatatggacatggttagggctcaccgctgcttctaggaagaatttcacttcccttttggattctggctacagttgtgttcttgtacctggtggtgtgcaggagacttttcatatgcaacatgatgctgagaatgtcttcctttcaaggagaagaggatttgtgcgcatagccatggaacaggggagccctctggttccagtattctgctttggtcaggcacgcgtgtacaaatggtggaagccggattgtgatctctatcttaaactatctagagcaatcagattcaccccgatctgcttctggggagtttttggatcaccattaccgtgtcgacagcctatgcatgtggtcgttggtaaaccaatagaagtcacaaaaactctgaagccaactgacgaagagattgctaagtttcatggccagtatgtggaagcgcttagggatctgtttgagaggcacaagtcccgagtcggctatgatcttgagctgaaaattctttgaacaaaatctccaatggaaataattacttgtgtgtatccttcattaattgttaccttggagctggatttggacttaatataaatgactacatcatgtagtctacatgtattgcatgtctttagcatcgactgttgaagtaatggaatacgtttataaagcctgtaaattacatgtcgtcttgcacaagagtatgtggtaataataacatttgacccaaaaataatactagttaaatttttcct

SEQ ID NO: 205 - DNA, 1381 bp, Ricinus communis
  misc_feature (1347)..(1347): n is a, c, g, or t
actggagcacgaggacactgacatggactgaaggagtagaaaagggacgcaaaaaaagattttacatggcggagaggtcgatgctgctttattttcattaatacagaaagagtttgagcactgagcactgaatagcaagaagaagaagaagaagaaatgggggaagaagcgaatcataataataataataataatatcaatagtaatgatgagaagaatgaagagaaatcaaattatacagttgtaaattcgagagaactatacccaacgaacatatttcacgcactgttagcgttgagcatatggattggttcaatccatttcaatctcttcttactcttcatctcttatctcttcctttcttttcccacattcctcctgattgttggattttttgtggtgttaatgttcattccgatcgacgaacacagtaagttgggccgtcgtttgtgcaggtatgtatgcagacatgcgtgcagtcattttccggtaactctccatgttgaagacatgaatgcttttcattctgatcgtgcttacgtttttggttatgagccacattcagtatttccccttggtgtttctgtactatcagatcactttgctgtcctgccccttcctaaaatgaaggtccttgcaagtaacgctgtgtttcggacaccagttttaaggcatatatggacatggtgtggtcttacatcagcaacaaagaaaaatttcactgccctcctagcatctggttatagttgcattgtgattcccggtggagttcaagagacattttatatgaagcatggctctgagattgctttccttaaggcgagaagagggtttgtccgagtagctatggagatgggtaaacccttggttccagttttctgctttggtcaatcgaacgtgtacaagtggtggaaacctgatggcgagttatttatgaaaattgctagagctattaagttcagcccaattgtcttttggggagttctcggttctcatttaccgctacaacgtccaatgcatgttgtcgtcggtaaaccgattgaggtgaagcaaaatccacagcctacagtggaagaggtctcagaagtacagggtcagtttgttgcggcacttaaagatctttttgaaaggcataaagcacgggttggctatgcagaccttacacttgaaattctttgatagaagtcagtacttgttttagttcagttggatgcctctttcagtttttggcgataatgtttgtattcattagataattaggaaaatgaaatgtaaaacggtgaataaagcttttcaatatgcgggcatcacaaagttgttctagatatccaaaaaaaaaaaaaaacnctgtatgccgttacgtaccgtatcgttgacagca

SEQ ID NO: 206 - DNA, 1257 bp, Vernicia fordii
agaagggcgatgcacatgatactctcctcttaataagagtattgatacccagagaagccagaagcaagaaacaaacaacttttgcaagaaggagattaaaatggggatggtggaagttaagaatgaagaagaggttaccatattcaaatctggagaaatatacccaacaaacatttttcaatcagtgttagctttggctatatggcttggctctttccatttcatcctcttcttagtctcttcttcaatcttccttcctttctccaaatttctcctcgttattgggttgcttttgttttttatggtgattcctatcaacgatcgcagtaagcttggccaatgcttgttcagctatatatctaggcatgtttgcagctattttcccatcactcttcatgttgaagatataaatgcctttcgttctgatcgtgcttacgtgtttggttatgagccacattcagtttttcccattggtgtgatgattctttctttgggtttaattcctcttcctaatataaaattccttgcaagtagtgctgtgttctacactccatttttaagacatatatggtcatggtgtggtcttacaccagcaacaaggaaaaattttgtttccctcctgtcttctggttatagttgcattctggtgcctggtggagtccaagagacattttatatgaagcaggactctgagattgctttccttaaggcaagaagaggatttattcgaatagctatgcagacgggcacacccttggttcctgttttctgctttggtcaaatgcacacattcaaatggtggaaacctgatggagagttgttcatgaaaattgctagagctattaaattcaccccaactatcttttggggagttctcggaactcctttacccttcaaaaatccaatgcatgtcgtggtgggtagacccattgaggtgaagcaaaatccacagcctaccgctgaagaggttgcggaagtacagagagagtttattgcatcacttaaaaatctctttgaaaggcacaaagcacgggtcggctattcagaccttaaacttgaaattttttgaccagaaatcagaacttaaaagtagttttgcatgctttctcattttcatttatttagtttttttttaaacctttttttttcccttttgttaatttgtgttcttagataatgatgaaaatgagaaaaaaaaaaaatttgtaaaacagctaataagccttaattttgtggcaaaaaaaaaaaaaaaaaaaa

SEQ ID NO: 207 - DNA, 1280 bp, Mortierella ramanniana
  misc_feature (1265)..(1266): n is a, c, g, or t
  misc_feature (1269)..(1269): n is a, c, g, or t
  misc_feature (1275)..(1275): n is a, c, g, or t
  misc_feature (1277)..(1277): n is a, c, g, or t
  misc_feature (1279)..(1279): n is a, c, g, or t
tgcaaagtcacactttcagtcagccatggccagcaaggatcaacatttacagcagaaggtcaagcatacgctagaagctatcccatcccctcgctatgctccattgcgagtgccattaagacggagattacaaacattggcagttttattatggtgttccatgatgtcaatatgcatgttcatattcttctttttatgctccattcctgttctcctttggttccccattatcctttatttgacctggatcttggtgtgggataaggcgccagagaacggtggaagacctattcgctggctgcggaatgctgcttggtggaagctgtttgcagggtattttcccgcacatgtcatcaaggaagccgatttagatccatccaagaactacatctttggttatcacccccatggaatcatatccatgggctcgttctgtacttttagtaccaatgctactggctttgatgacttgttcccaggcatccggccatcgcttttgacattaacatctaattttaatatcccactttatcgtgattatttgatggcgtgcggactttgctccgtctccaaaacatcctgtcaaaatattttaaccaaaggtggtccgggccgttccattgccattgtcgtgggaggtgcttccgagtctctcaatgctagacccggtgtcatggaccttgtgttgaagagacgctttggttttatcaagattgctgttcaaaccggtgcaagtctagtgcccactatcagttttggtgaaaatgagctgtacgaacagattgaaagcaatgaaaactcaaagttgcatagatggcaaaagaagattcaacatgcccttggttttactatgccgctctttcatggacgcggtgtattcaattatgactttggtttgctcccccatcgccatcctatctacacgattgttggaaagcccatccccgtccctagcatcaagtatggacagacaaaggatgagattataagagaactacatgactcgtacatgcatgccgtgcaggatctctatgatcgttacaaggatatctatgcaaaggatcgggtaaaagaactagaattcgtcgaatagttgggttgttaccatttaacgttttcttcaaatttttcattgattataccgcttcatcccgacctggttttttattgaatgggtttctcatctccagttcaattcccactcctgcatgtatctattatcatcatcctttctaataatgaaaaccttttgaacgtttcataannaanagaaananana

SEQ ID NO: 208 - DNA, 2485 bp, Homo sapiens
tgccccgttgtgaggtgataaagtgttgcgctccgggacgccagcgccgcggctgccgcctctgctggggtctaggctgtttctctcgcgccaccactggccgccggccgcagctccaggtgtcctagccgcccagcctcgacgccgtcccgggacccctgtgctctgcgcgaagccctggccccgggggccggggcatgggccaggggcgcggggtgaagcggcttcccgcggggccgtgactgggcgggcttcagccatgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactgagccagccttcggggccaattccctggaggaaccagctgcaaatcacttttttgctctgtaaatttggaagtgtcatgggtgtctgtgggttatttaaaagaaattataacaattttgctaaaccattacaatgttaggtcttttttaagaaggaaaaagtcagtatttcaagttctttcacttccagcttgccctgttctaggtggtggctaaatctgggcctaatctgggtggctcagctaacctctcttcttcccttcctgaagtgacaaaggaaactcagtcttcttggggaagaaggattgccattagtgacttggaccagttagatgattcactttttgcccctagggatgagaggcgaaagccacttctcatacaagcccctttattgccactaccccacgctcgtctagtcctgaaactgcaggaccagtttctctgccaaggggaggagttggagagcacagttgccccgttgtgtgagggcagtagtaggcatctggaatgctccagtttgatctcccttctgccacccctacctcacccctagtcactcatatcggagcctggactggcctccaggatgaggatgggggtggcaatgacaccctgcaggggaaaggactgccccccatgcaccattgcagggaggatgccgccaccatgagctaggtggagtaactggtttttcttgggtggctgatgacatggatgcagcacagactcagccttggcctggagcacatgcttactggtggcctcagtttaccttccccagatcctagattctggatgtgaggaagagatccctcttcagaaggggcctggccttctgagcagcagattagttccaaagcaggtggcccccgaacccaagcctcacttttctgtgccttcctgagggggttgggccggggaggaaacccaaccctctcctgtgtgttctgttatctcttgatgagatcattgcaccatgtcagacttttgtatatgccttgaaaataaatgaaagtgagaatcctcaaaaaaaaaaaaaaaaaaaaaaaaaaaaaaaaa

SEQ ID NO: 209 - DNA, 1411 bp, Homo sapiens
actgttctgagatctttgcctccctcaggctcccgagaatcatggctcattccaagcagcctagtcacttccagagtctgatgcttctgcagtggcctttgagctaccttgccatcttttggatcttgcagccattgttcgtctacctgctgtttacatccttgtggccgctaccagtgctttactttgcctggttgttcctggactggaagaccccagagcgaggtggcaggcgttcggcctgggtaaggaactggtgtgtctggacccacatcagggactatttccccattacgatcctgaagacaaaggacctatcacctgagcacaactacctcatgggggttcacccccatggcctcctgacctttggcgccttctgcaacttctgcactgaggccacaggcttctcgaagaccttcccaggcatcactcctcacttggccacgctgtcctggttcttcaagatcccctttgttagggagtacctcatggccaaaggtgtgtgctctgtgagccagccagccatcaactatctgctgagccatggcactggcaacctcgtgggcattgtagtgggaggtgtgggtgaggccctgcaaagtgtgcccaacaccaccaccctcatcctccagaagcgcaaggggttcgtgcgcacagccctccagcatggggctcatctggtccccaccttcacttttggggaaactgaggtgtatgatcaggtgctgttccataaggatagcaggatgtacaagttccagagctgcttccgccgtatctttggtttctactgttgtgtcttctatggacaaagcttctgtcaaggctccactgggctcctgccatactccaggcctattgtcactgtggttggggagcctctgccactgccccaaattgaaaagccaagccaggagatggtggacaaataccatgcactttatatggatgctctgcacaaactgttcgaccagcataagacccactatggctgctcagagacccaaaagctgtttttcctgtgaatgaaggtactgcatgcccaggagcacaggagtgcctgccttgaagaagagactcatctgccactaaccaaagacaggcaggagatgagggaggttatatgtggtaggggagggcatgaggaattccttctttgccttcttgccacagggtccttacaggaattctttctgaagagctgcacacagtcattcctcaaaggagggcatcctagtgcccctcatgctggggcctgatgcctggtcatcatttgagtcctctgggacacattagcagtcactgcatattcccccagcccctgggcaactatctactttctgtctctgtggatttgccaattctgaacattttatataaatggaataatacaataaaaaaaaaaaaa

SEQ ID NO: 210 - DNA, 2488 bp, Bos taurus
gccgtggccgtggccaaggctccgctttccgccggtgctccggcccgtctggcggcccgtccctccgcaccctcggccgtagcggtccccgcgctcccctgctcggcgcgaagccctggccccggcggccggggcatgggccaggggcgcggggtctggcggcttcccgcggggccccgacctgtactggcttcgtcatgaagaccctcatagccgcctactccggggtcctgcgaggcactggctccagcatcctctctgccctccaggacctgttttctgtcacttggctcaataggtccaaggtagagaagcagctccaagtcatctcggtgctacaatgggtcctgtctttcctcgtgctgggagtggcctgcagcgtcatcctcatgtacacattctgcaccgattgctggctcattgccgtgctctacttcacctggctggtgtttgactggaacacacccaagaaaggtggcaggaggtcacagtgggtccgaaactgggctgtgtggcgctactttcgagactactttcccattcagctggtgaagacacacaacttactgaccagcaggaactacatctttgggtaccatccccatggcatcatgggcctgggtgccttctgcaacttcagcacagaggccacagaagtaagcaagaagttccctggcataaggccctacctggccacgctggccggcaacttccggatgccagtgctgcgggagtacctgatgtctggaggcatctgcccagtgaaccgggacaccatagactacttgctttcaaagaatgggagtggcaatgccatcatcatcgtggtggggggcgcggctgaatccctgagctccatgcccggcaagaatgcagtcaccctgcgcaatcgcaagggctttgtgaaactggccctgcgccatggagccgacctggttcccacctactcctttggggagaatgaggtgtacaagcaggtgatctttgaggagggctcctggggccggtgggtgcagaagaagttccagaagtacattggctttgccccatgcatcttccatggtcgaggcctcttctcctctgacacctgggggctggtgccctactccaagcccatcaccactgtcgtgggcgagcccattaccatccccaggctggagcgcccgacgcagcaggacatcgacctgtaccacgccatgtacgtgcaagccctggtgaagctcttcgaccagcataagaccaagttcggcctcccggagaccgaggtcctggaggtgaactgagcctgtctgcaggggccagcttctgggaggaaccatctgcaaatcgttttctaccaagttctcaagtgctttttgttctgtaaatttggaagcatcatgggtgtctgtgggttatttaaaagaaattataataattttgttaaaccgttacaatgttaggtcttttttaagaaggagaaagggaatatttcaagctctctcagttccagtttgtcctgttccaggtgggcgctgccacatctgggcctttatggtttcacaacccctcttctctcctcccccaaattacagagaaaattcagtcctggttaactggggaagaaggacagtcattagtgactcgggccagttagattatttgccctttggccctgagggatgaggggcagaagcctcctctagtacaaacatctctatgcccagctacccaaggcttgactgcaggactaaaccctcttgccaaggaaagacacagaggaaacaggtgttcccatgctgaagagtgcagggataagcacctggaatattcaagcttgattctcctttctgccacccccatggccccagtctctgaaatctgagcctggactggcctccaaagagaggatcagggtggcagtgttcctgtgctggagaatggagctgtccagatgaaccatctcttgggttatcaagccccatcatgttctggttggagtgactggttttcctcagggggctgatgacacagacccagacccagcacagaccctgccttggcctgccagtggcctcgctttgcttaacccacatcctcagcagtggatgcgaggaaggggtcccctttcctgtttacagaggggcctgagcagtagactggtaccagaacagaagttccccgaacccaaacctcatgtatttgtgccttttctgagaggggggccaggggggacagctagtactctgtgtactctgctttctcttgatgagatcattataccatgtcagactttcgtatattcctaaatggataaatgaaaacaagtgtcctctatgagttattgttagggtcacattagcatcttgctgctgatgattggggagaccactgccccagctgggctgcctgctaagccctctcccactttctccttcagcccaaatggccctttgtatattagttatcaattgctgtgtaataaattactccaaaacttggtggctgc

SEQ ID NO: 211 - DNA, 1330 bp, Mus musculus
ggtcaggggcgcggcgtgaggcggctttctgcacggccgtgacgtgcattggcttcagcatgaagaccctcatcgccgcctactccggggtcctgcggggtgagcgtcgggcggaagctgcccgcagcgaaaacaagaataaaggatctgccctgtcacgcgaggggtctgggcgatggggcactggctccagcatcctctcagccctccaagacatcttctctgtcacctggctcaacagatctaaggtggaaaaacagctgcaggtcatctcagtactacaatgggtcctatccttcctggtgctaggagtggcctgcagtgtcatcctcatgtacaccttctgcacagactgctggctgatagctgtgctctacttcacctggctggcatttgactggaacacgcccaagaaaggtggcaggagatcgcagtgggtgcgaaactgggccgtgtggcgctacttccgagactactttcccatccagctggtgaagacacacaacctgctgaccaccaggaactatatctttggataccacccccatggcatcatgggcctgggtgccttctgtaacttcagcacagaggctactgaagtcagcaagaagtttcctggcataaggccctatttggctacgttggctggtaacttccggatgcctgtgcttcgcgagtacctgatgtctggaggcatctgccctgtcaaccgagacaccatagactacttgctctccaagaatgggagtggcaatgctatcatcatcgtggtgggaggtgcagctgagtccctgagctccatgcctggcaagaacgcagtcaccctgaagaaccgcaaaggctttgtgaagctggccctgcgccatggagctgatctggttcccacttattcctttggagagaatgaggtatacaagcaggtgatctttgaggagggttcctggggccgatgggtccagaagaagttccagaagtatattggtttcgccccctgcatcttccatggccgaggcctcttctcctctgacacctgggggctggtgccctactccaagcccatcaccaccgtcgtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagcccgcgcgtgccagctcctgggagggacgactgcagatccttttctaccgagttctcgagtgcattttgttctgtaaatttggaagcgtcatgggtgtc

SEQ ID NO: 212 - protein, 314 aa, Arabidopsis thaliana
MGGSREFRAEEHSNQFHSIIAMAIWLGAIHFNVALVLCSLIFLPPSLSLMVLGLLSLFIFIPIDHRSKYGRKLARYICKHACNYFPVSLYVEDYEAFQPNRAYVFGYEPHSVLPIGVVALCDLTGFMPIPNIKVLASSAIFYTPFLRHIWTWLGLTAASRKNFTSLLDSGYSCVLVPGGVQETFHMQHDAENVFLSRRRGFVRIAMEQGSPLVPVFCFGQARVYKWWKPDCDLYLKLSRAIRFTPICFWGVFGSPLPCRQPMHVVVGKPIEVTKTLKPTDEEIAKFHGQYVEALRDLFERHKSRVGYDLELKIL

SEQ ID NO: 213 - protein, 340 aa, Ricinus communis
MGEEANHNNNNNNINSNDEKNEEKSNYTVVNSRELYPTNIFHALLALSIWIGSIHFNLFLLFISYLFLSFPTFLLIVGFFVVLMFIPIDEHSKLGRRLCRYVCRHACSHFPVTLHVEDMNAFHSDRAYVFGYEPHSVFPLGVSVLSDHFAVLPLPKMKVLASNAVFRTPVLRHIWTWCGLTSATKKNFTALLASGYSCIVIPGGVQETFYMKHGSEIAFLKARRGFVRVAMEMGKPLVPVFCFGQSNVYKWWKPDGELFMKIARAIKFSPIVFWGVLGSHLPLQRPMHVVVGKPIEVKQNPQPTVEEVSEVQGQFVAALKDLFERHKARVGYADLTLEIL

SEQ ID NO: 214 - protein, 322 aa, Vernicia fordii
MGMVEVKNEEEVTIFKSGEIYPTNIFQSVLALAIWLGSFHFILFLVSSSIFLPFSKFLLVIGLLLFFMVIPINDRSKLGQCLFSYISRHVCSYFPITLHVEDINAFRSDRAYVFGYEPHSVFPIGVMILSLGLIPLPNIKFLASSAVFYTPFLRHIWSWCGLTPATRKNFVSLLSSGYSCILVPGGVQETFYMKQDSEIAFLKARRGFIRIAMQTGTPLVPVFCFGQMHTFKWWKPDGELFMKIARAIKFTPTIFWGVLGTPLPFKNPMHVVVGRPIEVKQNPQPTAEEVAEVQREFIASLKNLFERHKARVGYSDLKLEIF

SEQ ID NO: 215 - protein, 355 aa, Mortierella ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 216 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 217 - protein, 328 aa, Homo sapiens
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 218 - protein, 361 aa, Bos taurus
MKTLIAAYSGVLRGTGSSILSALQDLFSVTWLNRAKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 219 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 220 - protein, 3 aa, Artificial Sequence
  conserved sequence
YFP

SEQ ID NO: 221 - protein, 4 aa, Artificial Sequence
  conserved sequence
HPHG

SEQ ID NO: 222 - protein, 4 aa, Artificial Sequence
  conserved sequence
EPHS

SEQ ID NO: 223 - protein, 24 aa, Artificial Sequence
  conserved sequence
  X (2)..(2): any amino acid
  X (5)..(5): any amino acid
  X (6)..(6): Lysine (K) or Arginine (R)
  X (7)..(7): any amino acid
  X (9)..(11): any amino acid
  X (13)..(15): any amino acid
  X (16)..(16): Leucine (L) or Valine (V)
  X (19)..(21): any amino acid
  X (24)..(24): Glutamic Acid (E) or Glutamine (Q)
RXGFXXXAXXXGXXXXVPXXXFGX

SEQ ID NO: 224 - protein, 8 aa, Artificial Sequence
  conserved sequence
  X (3)..(3): any amino acid
  X (5)..(7): any amino acid
FLXLXXXN

SEQ ID NO: 225 - protein, 118 aa, Artificial Sequence
  conserved sequence
ALVVANHQSFLDPLVLSALLPRKGGRVRFVAKKELFYVPLLGWLLRLLGAIFIDRENGRLARAALREAVRLLRDGGWLLIFPEGTRSRPGKLLPFKKGAARLALEAGVPIVPVAIRGT

SEQ ID NO: 226 - protein, 187 aa, Artificial Sequence
  conserved sequence
  X (15)..(15): any amino acid
  X (18)..(18): any amino acid
  X (23)..(23): any amino acid
  X (25)..(26): any amino acid
  X (28)..(30): any amino acid
  X (32)..(33): any amino acid
  X (35)..(38): any amino acid
  X (41)..(41): any amino acid
  X (46)..(48): any amino acid
  X (53)..(53): any amino acid
  X (55)..(57): any amino acid
  X (61)..(61): any amino acid
  X (67)..(67): any amino acid
  X (72)..(72): any amino acid
  X (74)..(77): any amino acid
  X (79)..(79): any amino acid
  X (114)..(114): any amino acid
  X (127)..(128): any amino acid
  X (136)..(136): any amino acid
  X (139)..(142): any amino acid
  X (144)..(144): any amino acid
  X (150)..(150): any amino acid
  X (164)..(165): any amino acid
  X (167)..(172): any amino acid
AVFDKDGTLTEDDTXFLXYLLKXLXXLXXXLXXDXXXXGSXLTLSXXXDLLEXLXXXGGIXVIGLAXRYLEXLXXXXEXAKLFEGFIKPDAAELLKELHEAGLRVVVLTGDPRXIAKPVAKELGIDXXNVLATELXDEXXXXVXGRITGXLDKARAVERLVVLXXKXXXXXXVVAIGDSANDLPALK

SEQ ID NO: 227 - protein, 190 aa, Artificial Sequence
  conserved sequence
IKAVVFDKDGTLTDGEPPIAEAIVEAAAELGLPLLLPLEEVEKLLGRGVEGIERILLEGGLTAELLLELEGELAAGKTAVLVALDGEVLGLIALADKLYPGAREALKALKERGIKVAILTNGDRANAEAVLEALGLADLFDVIVDSDDVGPVKPKPEIFLKALERLGVKPEEVLMVGDGVNDAPALAAAG

SEQ ID NO: 228 - protein, 15 aa, Artificial Sequence
  conserved sequence
GDLVICPEGTTCREP

SEQ ID NO: 229 - protein, 6 aa, Artificial Sequence
  conserved sequence
  X (2)..(2): any amino acid
  X (4)..(4): any amino acid
  X (5)..(5): Threonine (T) or Valine (V)
  X (6)..(6): Leucine (L) or Valine (V)
DXDXXX

SEQ ID NO: 230 - protein, 8 aa, Artificial Sequence
  conserved sequence
  X (2)..(2): 17 to 20 amino acids; where the amino acids can be any amino acids
  X (3)..(3): Glycine (G) or Serine (S)
  X (4)..(4): Aspartic Acid (D) or Serine (S)
  X (5)..(7): any amino acid
  X (8)..(8): Aspartic Acid (D) or Asparagine (N)
KXXXXXXX

SEQ ID NO: 231 - DNA, 1580 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaaggtttcgagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttctaatgctccaagttcagat

SEQ ID NO: 232 - DNA, 1584 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaatttctatttcttccgcttcttcttcttttttttcttttgttgggttctgcttagggtttgtatttcagtttcagggcttgttcgttggttctgaataatcaatgtctttgccccttttctaatgctccaagttcagat

SEQ ID NO: 233 - DNA, 1470 bp, Arabidopsis thaliana
cagggtttatttaacttgccctttctcgtttcctcctttttttcttaaaccactctgcttcctcttcctctgagaaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttgtttcagggcttgttcgttggttctgaataatcaatgtctttgccccttttctaatgct

SEQ ID NO: 234 - DNA, 1397 bp, Arabidopsis lyrata
cagggtttatttaacttgccctttctcgtttcctcctttttttcttaaaccactcttccttcttcctctgatttcccagattttaatgaagaggcgcttaaccacttccacttcttcttcttctccatcttcctctgtttcttcttctactactacttcctctcctattcaatcggaggctcccaggcctaaacgagccaaaagggctaagaaatcgtctccttctggtgataaatcacataacccgacaagccctgcttctaccagacgcagctctatctacagaggagtcactagacatagatggactgggagattcgaggctcatctttgggacaaaagctcttggaattcgattcagaacaagaaaggcaaacaaggagcatatgacagcgaagaagcagcagcacatacgtacgatctggctgctctcaagtactggggacccgacaccatcttgaattttccggcagagacgtacacaaaggaattggaagagatgcagagagtgacaaaggaagaatatttggcttctctccgccgccagagcagtggtttctccagaggcgtctctaaatatcgcggcgtcgctaggcatcaccataacggaagatgggaggctcggattggaagagtgtttgggaacaagtacttgtacctcggcacctataatacgcaggaggaagctgctgcggcgtatgatatggcggcgatagagtatcgaggtgcgaacgcggttactaattttgacattagtaattacatcgaccggttaaagaagaaaggtgttttcccgttccctgtgaaccaacctaatcatcaagaggctattcttgttgaagccaaacaagaaatcgaaacgagagaagctaaagaagagcctagagaagaagtgaaacaacagtacgtggaagaaccaccacaagaagagaaagaagaagagaaagcagagcaacaagaagcagagtttgtaggatataaagatgaaggggcggtggtcaattgctgcatagactcttcagccataatggaaatgaatcgttgtggggacaacaatgagctggcttggaacttctgtatgatggattcagggtttgctccgtttttgacggatcagaatctctcaaatgagaatcccatcgagtatccggagcttttcaatgagttagcatttgaggataacattgacttcatgttcgacgaagccaagaacgactgcctgagcttggaaaatctggattgttgcgtggtgggaagagagagcccaacttcttcgtcttcaccattgtcttgcttttctactgactctgcttcatcaacaacaacaacaacctcggtttcttgtaactatttgggcttgttcgttggttctgaataatcaatgtctttgccccttt

SEQ ID NO: 235 - DNA, 1242 bp, Brassica napus
atgaagagacccttaaccacttctccttcttcctcctcttctacttcttcttcggcctgtatacttccgactcaatcagagactccaaggcccaaacgagccaaaagggctaagaaatcttctctgcgttctgatgttaaaccacagaatcccaccagtcctgcctccaccagacgcagctctatctacagaggagtcactagacatagatggacagggagatacgaagctcatctatgggacaaaagctcgtggaattcgattcagaacaagaaaggcaaacaagtttatctgggagcatatgacagcgaggaagcagcagcacatacgtacgatctagctgctctcaagtactggggtcccaacaccatcttgaactttccggttgagacgtacacaaaggagctggaggagatgcagagatgtacaaaggaagagtatttggcttctctccgccgccagagcagtggtttctctagaggcgtctctaaatatcgcggcgtcgccaggcatcaccataatggaagatgggaagctcggattggaagggtgtttggaaacaagtacttgtacctcggcacctataatacgcaggaggaagctgcagctgcatatgacatggcggctatagagtacagaggtgcaaacgcagtgaccaacttcgacattggtaactacatcgaccggttaaagaaaaaaggtgtcttcccgttccccgtgagccaagctaatcatcaagaagctgttcttgctgaaaccaaacaagaagtggaagctaaagaagagcctacagaagaagtgaagcagtgtgtcgaaaaagaagaagctaaagaagagaagactgagaaaaaacaacaacaagaagtggaggaggcggtgatcacttgctgcattgattcttcagagagcaatgagctggcttgggacttctgtatgatggattcagggtttgctccgtttttgactgattcaaatctctcgagtgagaatcccattgagtatcctgagcttttcaatgagatgggttttgaggataacattgacttcatgttcgaggaagggaagcaagactgcttgagcttggagaatcttgattgttgcgatggtgttgttgtggtgggaagagagagcccaacttcattgtcgtcttctccgttgtcctgcttgtctactgactctgcttcatcaacaacaacaacagcaacaacagtaacctctgtttcttggaactattctgtctga

SEQ ID NO: 236 - DNA, 1248 bp, Brassica napus
atgaagagacccttaaccacttctccttctacctcctcttctacttcttcttcggcttgtatacttccgactcaaccagagactccaaggcccaaacgagccaaaagggctaagaaatcttctattcctactgatgttaaaccacagaatcccaccagtcctgcctccaccagacgcagctctatctacagaggagtcactagacatagatggacagggagatacgaggctcatctatgggacaaaagctcgtggaattcgattcagaacaagaaaggcaaacaagtttatctgggagcatatgacagcgaggaagcagcagcgcatacgtacgatctagctgctctcaagtactggggtcccgacaccatcttgaactttccggctgagacgtacacaaaggagttggaggagatgcagagatgtacaaaggaagagtatttggcttctctccgccgccagagcagtggtttctctagaggcgtctctaaatatcgcggcgtcgccaggcatcaccataacggaagatgggaagctaggattggaagggtgtttggaaacaagtacttgtacctcggcacttataatacgcaggaggaagctgcagctgcatatgacatggcggctatagagtacagaggcgcaaacgcagtgaccaacttcgacattagtaactacatcgaccggttaaagaaaaaaggtgtcttcccattccctgtgagccaagccaatcatcaagaagctgttcttgctgaagccaaacaagaagtggaagctaaagaagagcctacagaagaagtgaagcagtgtgtcgaaaaagaagaaccgcaagaagctaaagaagagaagactgagaaaaaacaacaacaacaagaagtggaggaggcggtggtcacttgctgcattgattcttcggagagcaatgagctggcttgggacttctgtatgatggattcagggtttgctccgtttttgacggattcaaatctctcgagtgagaatcccattgagtatcctgagcttttcaatgagatggggtttgaggataacattgacttcatgttcgaggaagggaagcaagactgcttgagcttggagaatctggattgttgcgatggtgttgttgtggtgggaagagagagcccaacttcattgtcgtcttcaccgttgtcttgcttgtctactgactctgcttcatcaacaacaacaacaacaataacctctgtttcttgtaactattctgtctga

SEQ ID NO: 237 - DNA, 868 bp, Glycine max
gaggctccaaatgaagaggtctccagcatcttcttgttcatcatccacttcctctgttgggtttgaagttcatcatcccattgaaaaaagaaggcctaagcatccaaggaggaataatttgaagtcacaaaaatgcaagcagaaccaaaccaccactggtggcagaagaagctctatctatagaggagttacaaggcataggtggacagggaggtttgaagctcacctatgggataagagctcttggaacaacattcagagcaagaagggtaaacaagtttatttgggggcatatgatactgaagaatctgcagcacgtacctatgaccttgcagcccttaagtactggggaaaagatgccaccctgaatttcccgatagaaacttataccaaggacctcgaggaaatggacaaggtttcaagagaagaatatttagcttctttgcggcgccaaagcagtggcttttctagaggcatctctaagtaccgtggggttgctaggcatcatcataatggtcgctgggaagctcgcattggaagagtatgtggaaacaagtacctctacttgggaacatataaaactcaagaggaggcagcagtggcatatgacatggcagcaattgagtaccgtggagtcaatgcagtgaccaattttgacataagcaactacatggacaaaataaagaagaaaaatgaccaaaccctacaacaacaacaaacagaagtacaaacagaaacagttcctaactcctctgactctgaagaagcagaagtagaacaacaacacacaacaacaataactacaccacccccatctgaaaatctgcacatgctaccacaggaacaccaagtaggtggatgggtgtga

SEQ ID NO: 238 - DNA, 1254 bp, Jatropha curcas
atgaagaggtcttctgcttcatcttgctcttcttcttcttcttcttcttcttctccatcctcttcttcgtcttctgcttgttctgcttcgtcttcttgcttagattcagtatctcctcctaatcaccatcaattacgatcagagaaatcaaaatccaaacgcattcgaaaaattcaaaccaagcaagataaatgtcagactacagctactaccaccagtccaagcggcggcggtaggagaagctccatttacagaggagtcacccggcatagatggactggaaggtttgaagctcatctttgggataagagttcttggaataacattcaaaacaagaaaggaaggcaagtttatttgggggcttacgacaatgaggaagcagctgctcatacctatgatcttgctgctctcaagtactggggacaagacaccactttgaattttccgatagaaacatactcaaaggagcttgaagagatgcaaaagatgagcaaggaagagtacttagcatctcttcgacggagaagcagtggattttcaagaggagtttctaagtaccggggagtagctaggcatcatcacaatggccggtgggaagctcgaattggccgggtttttggcaataagtatctctacctcggaacttacaatacacaagaagaggcagcagcagcatatgatatggcagcaatagagtacagaggagcaaatgcagtaaccaattttgatgtcagccattacatagaccgtttgaagaagaaaggcattcctttagataaaatcctaccagaaacactttctaaaggctcaaaagagtcagaagaaatcgagcgaacctcacccttaccgttgccatcaccaccatcaccatcaataacaccattacacgaagaaatagtctcaccacagctgcttgaaactgaatgcccacaacatcctccatgtatggatacttgtactatgatcgttatggaccctatagaagagcacgagcttacttggagcttctgtctcgattcggggttagttccgctccctgtgcctgacctaccactagcaaatggctgtgagttaccagacttgttggatgacacaggctttgaagacaatattgacttgatatttgatgcttgttgcttcggaaatgatgccaaccctgcagatgagaatgggaaagagaggttgtcttccgcttcaacttctccatcttgttccacaacattaacttctgtttcttgtaactattctgtttga

SEQ ID NO: 239 - DNA, 1332 bp, Ricinus communis
atgaagaggtctcctacttccccgtgctcttcttcttcatcatcttcatattcatcttcttcagcttcatcttcttgtgtcggtcctgatgatactcctgtcgctcctggtagtcatcatcatcatgatcaccaccaattacgatcgcagaaatcatccaaacgcattagaaaagttaaaaaaaagcagcagaaccataatattgatcagaataatactaacaccactattactgctcctacctctgccagaagaagctccatttacagaggagtcacccggcatagatggacgggaaggtttgaggcacacctttgggataagagttcatggaataacattcaaaacaagaagggaagacaaggggcctatgataatgaagaagcagctgctcatacttatgaccttgctgcccttaagtactggggaccagagacaaccttgaatttccccatagaaacatatcctaaagagcttgaagagatgcaaaagatgagcaaggaagagtacttggcatctcttcgacgccaaagcagtgggttttccagaggagtttctaagtaccgtggggttgctaggcatcaccacaatggtcgatgggaggcacgaatcggacgagtttttggcaacaagtatctctaccttggcacttataacacacaagaggaggcagcagcagcatatgatatggcagcaattgagtacagaggagcaaatgctgtgaccaattttgatatcagcaattacatagaccgcttgaagaagaaaggcatccttttagaccagatactccctgatcaaccacttagaaaatgctctagcgaatctgaagaagcagaagcagaagcagaagttgaacgactgccgtcactgccctcatcgatattaccacaagaacaggacacaatctcaccacaacttcaatgcacacagctccttccatccatggactcttgcacaatgattaatatggaccctatcgaagataatgagctcacctggagtttttgcttggattctgggctgacccttttctcagtacccgagctccccctcgaaaatgcttgcgagctaccggacttgttcgatgacacaggctttgaagacaatatagacttgatatttgatgggtgttgctttggaaatgatgatgacggtggtggtggtgccaaccaccaggaatttatggtggaaagtagaggatgtagggtaggggaggttgggatttcagggagcatggaggaggaaaacgggaaggagatgtgttgcagttcaagttcgccatcttgttcaacaaccacctcggtttcttgttgtaactattctgtttga

SEQ ID NO: 240 - DNA, 1209 bp, Populus trichocarpa
atgaagaggtcttcatcttgctcctcctcctcctcctcctcatcttcttcttgtgttgcctctgaaagcattcacaaaccaaaggccaaacgcattagaaagaatcaaaagagcaatcaaggcaaatcccagaatgctgctgctgctgctgctaataacagtcataactcaggcaaaagaagttccatttatagaggagtcaccagacatagatggacaggaaggtttgaagctcatctttgggataagagttcatggaacagcattcaaaacaagaagggaaaacaaggtgcctatgacaatgaggaggcagccgcacacacctatgatcttgctgccctgaagtactgggggtcagagacaaccttgaattttccgatagaaacatacactaaagagatcgaagagatgcaaaaggtgactaaagaagagtacttagcatctcttagacggcaaagcagtggattctctagaggagtctccaaataccgtggggtggctaggcatcatcataatggccgatgggaagctagaattggacgagtttatgggaataagtatctctaccttggaacttacaatacacaagaagaggcagcggcagcgtatgatatggcggcgatacagtatagaggagcaaatgcagtgaccaattttgatgttagcaattacatagaacggttgaggaagaaaggcatccctatagaccgaatcctccaagaacaacaacttcttaacaactcggtagattccagcgtggaagtggaagttgaacaaccaacaccaccaccacaacaacaacaagaggaacaagaacaaaagatagtctcgtcgtcttcgcaacttcaatgttcacagctaaattcaagcttggatggcacgcctcctatggtaattatggacactattgaagagcacgagctagcatggagcttttgtatggattcaggattgagcctcacaatgcctgatcttcctctcgaaaattcctgcgagttaccggacttgttcgatcatacagggtttgaggacaacattgacttgatattcgatgcatgttgctatggaaaggaggccaatccggctggctacacattagaagataatagcacaggaggagttgaagaggacaggttgtcgtctgattctgtctcaaattctccaactagttcaacaaccacctctgtttcttgtaactattctgtttga

SEQ ID NO: 241 - DNA, 1546 bp, Brachypodium distachyon
atgaagagatcccctcctcagccgtccccgtctccttcctcttcgccggcctcctcgtcgtcgtccccgtcctcctccgactcgtcttcctcgatcgccattccccgcaagagagcgaggacggcggcggcggcggcgggcggcggcaaggccagggcggcggccgccaagaggcccaagaaagatggcaaggactccggctcctcctccaatggcggcggcggcggcggcgggaagaggagctccatctacaggggagtcacgaggcacaggtggacaggtagatttgaggcgcatctctgggacaagaactgcttcacttcgcttcagaacaagaagaaaggcaggcaagtctatctgggggcttatgatacagaggaggcagctgctcgtgcatatgaccttgcagctctcaaatactggggtcctgaaacaacactaaatttctcagcggatgattatgggaaggagaggtcggagatggaggcggtgtcgcgggaggagtacctcgccgcccttcgccgccggagcagcggcttctcaaggggtgtctccaagtaccgcggggtcgccaggcatcaccataacgggcggtgggaggcgcgaatagggcgggtgctggggaacaagtacctttacctgggcacctttgatactcaagaggaggcagccagggcctatgatcttgcagccatccaataccgaggtgccaatgcagtaacgaacttcgacattagccgctacctggaccagccacagttactggaacaactgcagcagcagcaggggccacaggtggtggcagcattgcaagaggaagctcaacgtgatcaccaaagtgacaatgcagtccaagagctcaattcaggggaagcgcagacacctggtggcatcgatgagccgattgcaataggcgacagtactgaagacatcaacacctcccttacggttgatgacatcattgaagagagcctctggagtccttatgaatttgatatcatggctggagtgaacgtcagcaactcgatgaatctgagcgagttgttcagcgatgttgcctttgagggcaacattgggtgcctgtttgaagaatgctccggcatcgatgactgcagcagcaggcatggtgcaggtttggcagcatttggtttgtttacggaaggcgacgataagctgaaggatgtttcagagatggagatggaagtaaatcctcaagcaaatgatgtctcctgccctccaaaaatgatcactgtgtgcaattgagcatccttgtgcgtgcgtgagcatctttgtgttctgatgtccaaggaggtttttagctgtccatgttgggtatatttcttagaatagcttcttgtaggctgtctgatcaggtgggagagattcatgtgctcctccctatcctttgtgaaaaccccgaaggctgctgccaattgccatgatagtgcagtgtttcctttctttttcccccaattagcacaaggctaatatactaacctcaaaagatgtcctcacttaacctagattcaacaaattatattgtggt

SEQ ID NO: 242 - DNA, 1500 bp, Hordeum vulgare
ggcctccccactcttcctcggcccaccaccattgacacagagatcatgaagagatcccctcctccccagccatctccttcttcttcgccggcatgctcgccctcgccgtcttctccttcctcgtccgactcgtcttcgatagccattccccgcaagcgagcgcggacgcagaaggccgggagcgccaaggcgaaggccgcgcccaagcgggccaagaaagactcgggcaggagcaccaaggactctgacgcctccgccaatggcgccgccgcgtctgggaagagaagctccatctacaggggggtcacaaggcacaggtggacaggcagatttgaggcacacctctgggacaagaattgcttcacttccatccagaacaagaagaaagggaggcaagtctatctgggggcttatgacacagaggaggcagctgctcgtgcgtatgaccttgcagctctcaaatattgggggcctgaaaccacactgaatttcacggtggatgagtacgcgaaggagaggtcagagatggaggcggtgtcgcgggaggagtacctcgccgcgctccgccgccggagcagcggcttctccaggggggtctccaagtacaggggcgtcgccaggcaccaccacaatgggcgatgggaggcgcgaatcggaagggtgctggggaacaagtacctgtacctgggaacctttgatacccaagaggaagcagccagggcctatgatcttgctgccatcgaataccggggcgcaaatgccgtaaccaattttgacattagccgctacctggaccagccgcagttactggcgcaactggagcaggggccacaggtggtgccagcattgcaagaggagcttcaacatgatcaccaaagtgacaatgcagtacaagagctcaactctggtgaagcgcagaagccaggtagcgtcagcgagccgattgcagtggatgacacagacaatacaggagacatcggtgccccccttgtgtttgacagcggcgtcgaggagaacctgtggagcccttgcatggattatgatgtggaccccatctttggacccaacatcagcagctcgatgaatctgagcgagtggttcaacgatcccgccttcgagagcaacatcgggtacatgttcgaaggatgttcggacgtcgatgactgcagcaccaggcatggcgcaggtctgtcagcgttgggttttctcaaggaaggcgacgataagctgaaggatggttcagacatggaggcagaaataactcctcaggcaaacgatgtctcctgccctccaaaaatgatcaccgtgtgtaattgagcatctctgtgctctcatgtccaaggaaggtttcaggttttcatgttggttatacctcttagctagcttcttgtaggctgtctgtctgtctgatcaggtcagagaaattcatgtgttcattcccatcctttgagaaaaaacccaaaggcattcaacttggtatggcaagaatgccaatgctcc

SEQ ID NO: 243 - DNA, 1669 bp, Sorghum bicolor
ctcagattcaccgccgcgcgcgtctcctccccctgcaccaccaccagtacaccgttcatcgaggagagggacgggacgggacggagaccaccatggacatggagagatctcagcagcagaagtctccgacggagtctccgccgccgccgtcgccgtcgtcctcctcgtcctctgtctccgcggacaccgtcctgccccctcccgggaagaggcggagggcggcaacgacggccaaggccaaggccggcgccaagcctaagagggcccgtaaggacgccgccgccgcggctgatcctcctcctcctcccgccgccgccgccgccgggaagaggagctccgtctacaggggagtcaccaggcacaggtggacggggaggttcgaggcgcatctctgggacaagcactgcctcgccgcgctccacaacaagaagaaaggcaggcaagtctatctgggggcgtatgacagcgaggaggcagctgctcgtgcctatgaccttgcagctctcaagtactggggtcctgagaccctgctcaacttccctgtggaggattactccagcgagatgccggagatggagggcgtgtcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgatcttgcggccattgaataccgaggtgtcaatgctgtaaccaacttcgacattagctgctacctggaccacccactgttcctggcgcagctccaacaggaaccacaggtggtgccagcactcaaccaagaagctcaacctgatcagagcgaaacagaaactatagcccaagagtctgtgtcaagcgaagcgaagacaccagatgacaatgcagaacctgatgacaatgcagagcctgatgacatcgcggagcccctcatcacagtcgacgacagcatcgaagagagcttatggagcccttgcatggattatgagctagacaccatgtcaaggtctaactttggcagctcgattaatctgagcgagtggttcaatgatgcagacttcgacagcaacattggatgcctgttcgatgggtgttctgcggttgatgaaggcggcaaggatggtgtaggcctggcagatttcagtctgttggaagatttcagtctgtttgaagcaggtgatggtcagctgaaggatgttctttcagatatggaagagggaatccaacctccaacaatgatcagtgtgtgcaattgattctgaaacctatgcgtcgcgtgcgtgcctatgtgagatatccaaggaggttttcactttttaggtgtcctgtcttgggtatacttgatttgtccaatgccacagagccactgctgcaaaagcagctgaactttcttgtagaaagcccatggcagcttggcattagacaagtgtgttgatgttccttaattctttgaatttgttcgaggctgcttgactaaccttaagggtttgtcattgtcgcgcttagcctagattcaactaatcacatcctgaatctgaagtaattgtgcagtatcacaattttacatggc

SEQ ID NO: 244 - DNA, 1576 bp, Zea mays
ctcccccgcctcgccgccagtcagattcaccaccggctcccctgcacaaccgcgtccgcgctgcaccaccaccgttcatcgaggaggaggggggacggagaccacggacatggagagatctcaacggcagtctcctccgccaccgtcgccgtcctcctcctcgtcctccgtctccgcggacaccgtcctcgtccctcccggaaagaggcggagggcggcgacggccaaggccggcgccgagcctaataagaggatccgcaaggaccccgccgccgccgccgcggggaagaggagctccgtctacaggggagtcaccaggcacaggtggacgggcaggttcgaggcgcatctctgggacaagcactgcctcgccgcgctccacaacaagaagaaaggcaggcaagtctacctgggggcgtatgacagcgaggaggcagctgctcgtgcctatgacctcgcagctctcaagtactggggtcctgagactctgctcaacttccctgtggaggattactccagcgagatgccggagatggaggccgtttcccgggaggagtacctggcctccctccgccgcaggagcagcggcttctccaggggcgtctccaagtacagaggcgtcgccaggcatcaccacaacgggaggtgggaggcacggattgggcgagtctttgggaacaagtacctctacttgggaacatttgacactcaagaagaggcagccaaggcctatgaccttgcggccattgaataccgtggcgtcaatgctgtaaccaacttcgacatcagctgctacctggaccacccgctgttcctggcacagctccaacaggagccacaggtggtgccggcactcaaccaagaacctcaacctgatcagagcgaaaccggaactacagagcaagagccggagtcaagcgaagccaagacaccggatggcagtgcagaacccgatgagaacgcggtgcctgacgacaccgcggagcccctcagcacagtcgacgacagcatcgaagagggcttgtggagcccttgcatggattacgagctagacaccatgtcgagaccaaactttggcagctcaatcaatctgagcgagtggttcgctgacgcagacttcgactgcaacatcgggtgcctgttcgatgggtgttctgcggctgacgaaggaagcaaggatggtgtaggtctggcagatttcagtctgtttgaggcaggtgatgtccagctgaaggatgttctttcggatatggaagaggggatacaacctccagcgatgatcagtgtgtgcaactaattctggaacccgaggaggttttcgctttccaggtgtcctgtcttgggtaatccttgatctgtctaatgccacagtgccactgcaccagagcagctgagaactttcttgtagaaagcccatggcagtttggcgttagacaagtgtgtcgatgttctttaattctttgaatttgcccctaggctgcttggctaacgttaagggtttgtcattgtctcacttagcctagattcaactaatcacatcctgaatctgaaaaaaaaaaacaaaaaaaaaaaaaaa

SEQ ID NO: 245 - DNA, 1242 bp, Brachypodium distachyon
atggaggcctactgctccaccttggtgaaagacgagctcatcaatggcggcggcggggggtcagcaggagggatgcggtactgcgaggcggcgccgcgcgtctcgccgccggtggcgatcaagagcgtgaagagacggaagagggagccgccggcggtgtcggggatgacgacggtgagcggcggcgggaaggacggcgacaagtcggcgggcaatgcggcggccaagaggagctccaggttcaggggcgtcagcaggcatcgttggactggcaggttcgaggcgcacctgtgggacaaaggcacgtggaacccgacgcagaagaagaaaggaaagcaagtttatcttggggcgtacaacgaggaagaagcggcggcgagagcgtacgacctggcggcgctcaagtactggggacctaccacctacaccaacttcccggtggtggactacgagaaagagctgaaggtgatgcagggcgtgtcgagggaagaatacctagcctccataagaaggaagagcaacgggttctcgcgtggcgtgtccaagtatcgtggcgtggcgcggcaccaccacaacgggcggtgggaggcccggatcgggcgtgtcttcgggaacaagtacctgtacctaggcacctacagcacccaggaggaggccgcccgcgcctacgacatcgccgccattgagtaccggggcatcaacgctgtcaccaacttcgacctcagctcctacatccgatggctcaagcccaactccaccatcaacaccaacacccccgccgccgaattagccatcctcggcggcggcggcacgcccgcggcactgatcacgccgccgccgacgatgcacgttccccgcctgctaccgccgctcgtaaagggaaggggtagctcgatcgccgacgatgtgtctgccgggtcctgcgtgttcggcggcccgtcgccgtcaccgtcaccaaccacgacggcgctcagtttgctgttgcggtcatccgtgttccaggagttggtcgcgcagcagcagcctccgtcgaccgtggatgacgatgatgacatcggtggtcacgcggcggtgtccgacgcggcccaaagagcagcggaggagaacgaggagtcattcggcgaggtgttgtacggtgccggcgagggggaggcggcaacggcattctcgtgctccatgtacgagctgggcctggacgacaatttcgcgcgcatcgaggagtccctctggggctgcttgtga

SEQ ID NO: 246 - DNA, 1467 bp, Sorghum bicolor
atggaaacctacagcctgcaggtgaaggatgagctccacggcggcggcatcggcatcggaggaggagggcaggggctgtactgcggcgctacgccgaggccggcggctcctgcggccaccggcggcggcggcggcggcggggacggtgctgtgaagagtaataagaggagtaggaagagggagccgccgccgccgccgccgtcgtccctggtgacgatgagcaacggcggcaaggacgaggcggtcgccggcagcggcgacaagtcggcgagtagcaacagtaacgcgtccaagaggagctcaaggttcagaggcgtaagcaggcatcggtggacgggcaggttcgaggcgcacctgtgggacaaagggacatggaacccaacgcagaagaagaaagggaagcaagtttaccttggagcgtacaacgaggaagacgcggcagcaagagcgtatgatctggcagcgctcaagtactggggacctaccacctacaccaactttccggtcgtggactacgagagagagctcaaagtgatgcagaatgtgtccaaggaagagtaccttgcctccatacgaaggaagagcaacggcttctcccgcggagtttccaagtacaggggcgtcgcacggcaccaccacaacggcagatgggaggcacggatcggccgggtgttcggcaacaagtacctgtacctgggcacgtacagcacgcaggaggaggcggcgcgcgcctacgacatcgccgccatcgagtaccgcggcatcaacgccgtcaccaacttcgacctcagcacctacatccgctggctcaagcccggcggcggcgtcgaggacagcgccgccggcaccccgacgtcgggcgtcagggcgccgggtataccgccggcgtcgctgtccctacaggctggcggcctcctgcagcacccgcacggcgccgcggccggcatgctgcaggtcgacgtcgacgacctctaccgcgggcagctggccgcggcgcgtggggctgctctgttctctggcggcatcgacgacgtgggctccgtgtacgcagctggcagcgcagggcccagcccgacggctctgtgcgccgggaggccgtctccatcgccgtcgccgtcgtcgtccaccacggcgctcagcctgctgctgcgctcgtcagtgtttcaggagctcgtggcgcggaacgccggcggcggcgccgcgcagcagcagcagctcgtggtcgcggacgacgacggggcagtatcgccggcggacgttgttgacgccaaagttgagcagccggaggcagagggcgagctgggtcgtcacggtgaccagctctacggcgcggcgagggcggacgaggacgaggacgcgttcgcctgctccatgtacgagcttgacgacagcttcgcgcgcatggagcagtcgctctggggctgcctacgatcatcggatgcacctgataatatgaacaacctctga

SEQ ID NO: 247 - DNA, 1332 bp, Sorghum bicolor
atggagagcagtggaatgatgatggtgaagagcgagatcgagagctgcggctacccggggccgtcgtcgtcgacggcacctgcggcaggcgtggtcatcggcggcagcgcgacgacggaacgcggcgagggggggcaccatcatcatcatcatcaggtggtggtgaggaggaggaggagggagccgcctctgctcgcaccaatcgccggcggcggcattggcaagccgctgcccagcatcaccgtcaagaggagctccaggttccgtggagtcagcaggcatcgatggacaggtcgttttgaggcacatctgtgggacaagaactcgtggaatccgacgcagcggaagaagggcaaacaggtctatctgggagcttacgatgaggaggaggctgctgccagagcctacgaccttgctgctctcaagtactgggggcccaccacctacacgaacttcccggtcatggactacgagaaggagctcaagataatggagaacctcacaaaggaagagtaccttgcatcactgaggaggaagagcagtggtttttcaagaggagtgtccaagtacagaggcgttgccagacatcatcagaacgggaggtgggaggcaagaattgggcgcgtttttgggaacaagtacctttacctaggaacttacagcactcaagaagaagccgcccgcgcatacgacatcgcggcgatagagtacaaaggcgtgaacgcggtgaccaacttcgacctgaggtcctacatcacatggctgaaacccagcggtgctccggccgccttcaacccggaggcggcgctcctgatgcaggcagctccggccgagcagctcctccacccggcagagacggcccagatgctcccacgagtcggcaacccgttcctgctggaccacggcgccgcgccgccgggcagtagcggcggcggcgggcaggacgcctccatgtcgtccatggtgtctcccggtgccggcggcggcatgaggaggagaggctcctccaccgcgctcagcctgctgctcaagtcgtccatgttcaggcagctggtcgagaagaactccgacgccgaggagggcgtcagggacagggaagatgccgccgccgccgccgctgctgcgcatccagctggaccaggagacgcctatgagtaccacaacttcttccagggagaagcgcctccggacatgtgcgatctcttctcgtcaggcggcggtggcgaccacgcgcggaatgctgggttccatggagagatcgccgcgtgctacgatgatggcgaggggttggatggctggaatgggtttggcaacatgtcatctctgcaatag

SEQ ID NO: 248 - DNA, 1271 bp, Glycine max
aggtaaattacattgttgtctgctgaaataaaaaacagaagagtgaaatggagcttgcacctgtgaagtctgaactaagtccaaggagccataggttgctcatgatagatggtagtgaggttattggcactaagtgtgtcaaaaggcggcgaagagattcatctacggccgtgttaggtggcaatggacaacaaggtgaacagttagaagaacagaagcaacttggtggccaatcaactgccaccactgtgaagagaagctcaaggttcaggggtgttagcagacacaggtggactggaaggtttgaagcacatctatgggataaagggacctggaatcccactcagaagaagaaaggaaagcaagtatatttgggagcttataatgatgaagaagctgcagctagagcttatgatttggctgcactcaagtactggggaatatcaactttcacaaattttcctgtatctgattatgagaaagaaattgagataatgaaaactgtaaccaaagaagaatatcttgcttcattgagaaggaggagcagtggtttttccagaggtgtatcgaagtatagaggagtagcaaggcatcatcacaatggaagatgggaagcaaggattgggagagtgttcggtaacaagtacctctaccttgggacttacagtacacaagaagaagcagctcgcgcatatgacattgcagcaattgaatacagaggcataaatgcagtgacaaactttgacttgagcacctacataagatggctaagaccgggaacacatcctactgcttctcatgatcaaaagcctagcactgatgctcaaccttttgcaacctctaactccatgcaagcaagagggaacattgaggtatccaactccaacaagaattcattcccctcaggtaaattggacagtaccaagaagcgagacttttccaagtacatgaaccctttgagtccatgcaacaagccatcttccccaacagcattaggacttctcctaaaatcctcagtgtttagagaactgatgcagagaaatctgaactcttctagtgaagaagctgaagaagttgaattgaaatatccacatgagggcaatgatggagttggagggatttatgataatgaaaacaccaataactcttacttttgctcttctaatatcagcagattacctaacttggagtcatcagaagagagtccattgcctatgtatcatggaactgtgcaatcactatggaatagtgctttcaacatgtctaactga

SEQ ID NO: 249 - DNA, 1266 bp, Glycine max
caggtaaattacattgttgtctgctgagaaaaacagaagagtgaaatggagcttgcacctgtgaagtctgaactaagtccaaggagccataggttggtcattatagatggtagtgatgttattagcactaagtgtgccaaaaggcggcgaagagattcgtctatggccgtgttaggtggcaatggacaacaaggtgaacagttagaagaacagaagcaacttggtggccaatcaactgccaccactgtgaagagaagctcaaggttcaggggagttagcagacacaggtggactggaaggtttgaagcacatctatgggataaagggacctggaatcccactcagaagaagaaaggaaagcaagtatatttgggagcttataatgatgaagaagctgctgctagagcttatgatttggctgcactcaagtactggggaacatcaactttcacaaatttccctgtatctgattatgagaaagaaattgagataatgaaaactgtaaccaaagaagaataccttgcttcattgaggaggaggagcagcggtttttctagaggtgtatcaaagtatagaggagtagcaaggcatcatcacaatggaagatgggaagcaaggattgggagagtgttcggcaacaagtacctctaccttgggacttacagtacacaagaagaagcagcccgtgcatatgacattgcagcaattgaatacagaggcataaatgcagtgacaaattttgacttgagcacctacatcagatggctaagaccaggaacacatcctactgcttctcatgatcaaaagcctagcactgatgctcaactttttgcaacctctaactccatgcaaacaagagggaacattgaggtatccaactccaacatgcattcattcccctcaggtgaattggacagtaccaagaagcgagacttttccaagtacatgaaccctttgagtccttgcaacaagccatcttccccaacagcattaggacttctcctaaaatcctcggtgtttagagaactgatgcagagaaatctgaactcttctagtgaagaagctgatgttgaattgaaatatccacaagagggcaatgatggggttggagggatttatgataatgacaacaccagtaactcttacttttgctcttctaatatcagcagattacctaacttggagtcatcagaagagtgtccattgcctatgtatcatggaactatgcaatcactatggaatagtgctttcaacatgtctaactga

SEQ ID NO: 250 - DNA, 1257 bp, Populus trichocarpa
atggagatgacaaggaatactggcgatcagataagcctaggaaggcgtcgcttgtgcatgatagaagaagaaaggagagccggggaggctggtaagtgtattaaaagacgacgaagagacccttccacatttgcattaagctgcaatattaatgatcaacaaagtgaccagcagcagcagcaacagtcacttggtgatcgaactgcagctgttgccactactgtcaagagaagttcaagatttcggggagttagcaggcaccgttggaccggacgatttgaagctcatttatgggataaaggaacttggaatccaacacagagaaagaagggtaaacaaggagcttatgatgaagaagaatccgctgcaagagcatatgatttagctgctctcaagtactggggaacgtcaactttcacaaattttccggcgtctgactacgagaaagagattgaaataatgaaaacggtaaccaaagaagaatatctagcctccttgagaaggagaagcagtgggttttcaagaggtgtatccaaatacagaggagttgctaggcaccatcacaatgggagatgggaagcaaggatagggagagtgtttggaaacaaatatctttatcttggcacgtacagcactcaagaggaagctgctcatgcctatgatatagcagccattgaatacagagggatcaatgctgtaaccaatttcgatttaagcacatacatcagatggctgaagccagaagccagtcttcctgcacctcaaactcaagaatcgaagccagcttcagaccccctgccgatggcaaccttctccaatcaccttccgagcgagaaaccaacccagctatccgttctccagatggacccttctttaatggataatttaaacacccctaaaaacgaggacatttttcacaggaagacgcttcccgttagccccctcactaggtcatcctcctcgactgcccttagcctcctctttaaatcttcaatattcaaagagcttgtggagaagaacttgaataccacctccgaagaaattgaagaaaatgattcgaaaaacccgcataatggcaacaacaatgctggggaggcattctatgatggactcagccccattcctcacacaggcacttcaaccgaggatccgttcttgtgttcagagcaaggagagacaaatacattgccaccatacagtggaatggagcaatctctttggaatggagccttgagcatgccttctcgtttccattaa

SEQ ID NO: 251 - DNA, 1011 bp, Vitis vinifera
atggagatgactacagtgaaatctgaattaggcctggaaaggggccgcttgtgcactgcagaaactgatgctttggaggtgaccaagtgtgttaagagaaggagaagagatccatcagcagttacacccggatgcagtaaacaaggagagcagcagaagcaggtgttgctgcaggctgggcaatccattactgccattgccactactatgaagagaagttcaagattcaggggtgttagcagacatagatggacagggaggtttgaggctcatttatgggataaagggtcctggaatgtgacacagagaaaaaagggaaagcaagtctatcttggagcttatgatgaagaagaatctgctgcaagagcgtatgacttggccgcactgaagtattgggggccatcaacttttaccaatttcccagtatcagattatgagaaggagattgaaataatgcagggtctaacaaaggaggaatacttggcttctttaagaaggagaagcagtggtttttcaagaggagtgtccaagtacagaggagttgcaaggcatcatcacaacggaagatgggaagcaaggattgggagggtgtttggaaacaagtatctctaccttggaacttacagtacccaagaagaggctgctcatgcttatgacattgcagcaattgagtacagagggatcaatgctgtaacaaacttcgagttgagcacatacgtaaggtggctgaggcccagagccactgctcttacccctcaggaaccaagatcaaattcaataatgcaagcatcctctaactgccttccaaatgaggaagtagagctgtccttcctcagccccaatccttttacagtagatgacttggcaactcctctaaagcaagaaaagttccaaagagaggtttccatcagcccttgcaccaagtcatcttcgccaactgcactaagtctcctccatagatcttcagtatttagacaactggtggagaagaattcgaacagcatcgaataa

SEQ ID NO: 252 - DNA, 1170 bp, Glycine max
atggcaatgatgaaagagaatattattgaagtgagccttggaaggaggcaaatgtctatgacagaaggtgagttccaaggaacacggagcgtcaagagacgacgaagagaggttgctgcagccgcaggcagtggtgatgataaccaccaacagcagttaccacaacaagaagttggtgaaaatactacagtcaacactacaaagagaagctcaagatttcgcggtgttagcagacatagatggacgggtcgatatgaagctcacttgtgggacaagctttcttggaacataacacaaaagaagaaagggaagcaaggggcttatgatgaagaagaatctgctgccagagcatatgatttagctgcacttaagtattggggaacttcaactttcacaaattttccaatatcagattatgagaaagagatacaaataatgcagactatgaccaaagaggagtatttggccactttaaggagaaagagcagtggcttttcaagaggtgtatcaaagtataggggtgttgcgaggcaccaccacaatggtagatgggaagcaagaataggaagggtttttggaaacaaatatctctaccttggaacctacagcacccaagaggaagctgcgcgtgcttatgacatagcagccattgagtacagaggaattcatgctgtaacaaactttgatttgagcacttacataaaatggttaaagccttcaggaggaggcaccctagaagcaaatcttgaatcacatgcagcactagagcatcaaaaggtggcatccccatctaattatgctctaacagaagagtctaagtctttggcccttcacaacagttttttcagtccatattctctggattcccctgtaaagcatgaaagatttggaaacaaaacctaccaattctcaagcaataagtcatcttctcccactgcacttggtctccttctccgctcttcgttatttagggaattagttgaaaagaattcaaatgtttctggagaagaagatgatggggaagccacaaaggatcaacagacacaaatagctactgatgatgatctgggtggaatcttcttcgatagctttagtgatattccatttgtgtgtgaccccaatagatacgacttggaattgcaagaaagagacctgcactcaatattttga

SEQ ID NO: 253 - DNA, 1170 bp, Glycine max
atggtaatgatgaaagagaatattattgaagagaagcttggaaggagccaaatgtctatggtagaaggtgagttccaaggaacatggggtgtcaagagacgacgaagagaggttgctgcagcagcaagcagcggtgatgataaccaccaccagcagttaccacagcaagaagttggtgaaaattcttcaatcagcacaacaaagagaagctcaagatttcgcggtgttagcagacatagatggacgggtcggtatgaagctcacttgtgggacaaactctcttggaacataacacagaagaagaaagggaagcaaggggcttatgatgaagaagaatctgctgccagagcatatgatttagctgcacttaagtattggggaaattcaactttcaccaattttccaatatcagattatgagaaagagatagaaataatgcagactatgactaaagaggagtatttggccactttaaggagaaagagcagtggcttttcaagaggtgtatcaaagtatcggggcgttgcaaggcaccaccacaatggtagatgggaagcaagaataggaagggtttttggaaacaaatatctctaccttggcacctacagcacccaagaagaagctgcgcgtgcttatgacatagcagccattgagtacagaggaattcatgctgtaacaaactttgatttgagcacttacataaaatggttaaagccttcaggaggaggcaccccagaagaaaatcttgaatcacatgcagtactagagcatcaaaagttggcatccccatctaattatgctctaacagaagagtctaagtctttggtccttcccaacagttttatcagtccagattctctggattcacctgtaaagcatgaaagttttggaaacaaaacctaccaattctcaagaaataagtcatcttctcccactgcacttggtctccttctgcgctcttcattatttagagaattggttgaaaagaattcaaatgtttctggagaagaagctgatggggaagtcacaaaagatcaacagccacaactagctagcgatgatgatctggatggaatcttcttcgatagctttggcgatattccatttgtgtgtgatcccactagatacaacttggaattgcaggaaagagacctgcactcaatattttga

SEQ ID NO: 254 - DNA, 1179 bp, Medicago truncatula
atggcaatgttgatagaaaacgaagtcatgtgtttaggaaagagtcaaagatccatggatggaaaagaggtaaaaggagcacgtcgtgttaagagacaaagaagagatgctattgtaccaaaaataggtgatgatgctaacaagatggcacagaaacaagttggagaaaattctacaactaacacttcaaagagaagctcaagatttcgtggtgttagcaggcatagatggacgggtcgatttgaagctcacttgtgggacaagctttcttggaacacaacacaaaagaagaaagggaagcaaggggcttatgatgaagaagaatctgctgcaagagcatatgatttagctgcacttaagtattggggaacatcaactttcactaattttccgatatcagattatgataaagagatagagataatgaatactatgaccaaagaggagtacttggccacattaagaagaaaaagcagtggcttttcaagaggtgtctcaaagtatagaggtgttgcaaggcaccatcataatggtagatgggaagcaaggatagggagagtttttggaaacaaatatctctatcttggaacctatagtacacaagaagaagctgcacgtgcttatgatatagctgcaattgagtacagaggaattcatgctgtgaccaattttgaattgagtagctacataaaatggttaaagccagaaactactacagaagaaaatcatgaatcacaaatattacaaaaagagtctcgaacattagcaccccctaataactctactctattgcaagaatcaaagttattagcccttcaaaagagctttttcattccaaatgacctgaattcaactgaaaagcaagaatcatcatttgaaaacaaaaactatcatttcttgagcaacaagtcaacttctccaaccgcgcttagccttctccttcgctcttcgttgtttagagaattacttgaaaagaattcaaatgtatctgaggatgaagttacaaaagagcaacaacaacaacaaataactagtgatgatgaacttggaggaatcttctatgatggtattgacaatatttcatttgactttgatcccaacagctgcaacatagaattgcaagaaagagacttgcattcaatatcttgtttatatcaatacttaaattttggacaataa

SEQ ID NO: 255 - DNA, 1161 bp, Populus trichocarpa
atgatgatgataaagaatgaagaaaacccaggaaggcgccgcggatgcattgcagacagtgaagctcaggtagctcggtgtgtcaaaaggcggcgaagggatcctgctatagttgcactcggaagtgacgataatcaaagtcagcagcagatgccccagaaacaaactgatcaaacttctgctgctaccactgtgaagagaagctcaagatttcgtggcgtcagcagacatagatggacaggtcggtttgaagcccacctgtgggataagctctcatggaatgtaacacagaagaagaaagggaaacaaggagcttatgatgaagaagaatccgcggcgagagcatatgatttggctgctttgaagtattggggaacatcaacttttaccaattttccgatatcagattatgagaaagagattgagataatgcaaactgtaacgaaagaggagtatttagcatctctaagaagaaagagcagcggtttttcaagaggtgtatccaagtataggggagttgcaaggcaccatcacaatgggagatgggaagcgagaatagggagagttttcggaaacaaatacctttaccttggcacatacagcacgcaagaggaggctgcacgtgcttatgacattgcagcaattgagtacagagggatcaatgcggtgacgaactttgacttgagcacttatatcagatggataaagccaggagtagctgctcaagctgctgcaaatgaactacagacagtcacagatcctcagacagcagcgacattgactgatacctacactccaagagaggaaaccaaaccctcactgtttctacctaatcagttcactgcagattacctgaactccccaccaaagctagacgcatttcagaacaatatctttgtagattcttccaacaagacttcatcgcccactgccctcagcctcctcctacggtcttcggtatttagagaattggttgagaagaattcaaatgtttgtgaggaggaaactgatgggaatgagataaagaaccaaccaatggcaggtagtgatgatgaatatggtgggatattttatgatggaattggagatattccatttgtttactcttctaacaaatacagcctagggttggaagaaagagaactccagttcgtcttataa

SEQ ID NO: 256 - DNA, 1119 bp, Ricinus communis
atggaaatgatgatggtgaagaatgaagagatctcaggaaggcgccgtgcgagtgttacagaaagtgaggcttacgtagctcgttgtgtcaaaagacggcgcagagatgcagctgtagttacagttggtggtgatgacagtcaaagtcatcagcagcagcagcagcagcagccagagcaacaggctcatcaaatttctgctgctaccaccgtgaaaagaagttcaagatatcgtggtgtcagcaggcatagatggacaggcagatttgaagctcacctttgggataagctctcgtggaatgtaacacaaaagaagaaaggaaaacaaggagcttatgatgaagaagaatctgcggcaagggcatatgatttagctgcattgaagtattggggaacatcaactttcaccaattttccgatatcggattatgagaaagaaattgagataatgcaaactgtaacaaaagaggaatatttggcctcgttaagaagaaagagcagtggcttctcaaggggggtgtccaaatacaggggagttgcaaggcaccaccataatgggagatgggaagcaagaatagggagagtttttggaaacaaatacctttatcttggcacctatagcacacaagaggaggccgctcgtgcatatgacattgctgcaattgaatatagaggaatcaatgcagtgaccaactttgatttgagtacttacatcagatggctaaagccagaagttgctgcccaagtcgcagcaaatgaaccgcagactgttgcagagtctcggatgctgccatcgatcaataaccgtattgcaagagaagaatctaaaccttcattcttcagcgctactcctttcagtttagattgctggagttaccctcgtaaacaagaagagttccaaaacagaactcccattaccccttgcagcaagacgtcatcacccactgcacttagtctcctccttcggtcctcgatattcagggaattagttgagaagaattccaatgtctctgaagatgaaaatgaaggggaagagacgaagaaccaatcacaaataggcagtgatgatgagtttgggggactgttttacgaaagaattggtgacatcccatttatttaa

SEQ ID NO: 257 - DNA, 1137 bp, Brachypodium distachyon
atggccaagcaacgcacggacagcgccggcaccgatgccgccgccgtccaattgacgaagccgaagcggacgcggaagagcgtgccgcggcgggagagcccctcgcgccgcacctcggcgtaccgcggcgtcacgcggcaccggtggacggggcggttcgaggcgcacctgtgggacaagaacacctggacccagtcgcagaggaagaagaagggcaggcaagtttatctcggggcgtacggcggcgaggaagcggcggcgcgcgcctacgacctggcggcgttgaagtactggggccgcgacaccgtcctcaacttcccgttgtctaactacgacgaagagtggaaagaaatggaggggcagtccagggaagaatacatcggatccctccggaggaaaagcactggcttctcaagaggggtgtccaagtacagaggcgtcgcaaggcatcaccacaacggcaaatgggaggcgaggattgggcgtgtctacggcaacaagtatctctacctgggcacatatgggacgcaggaggaggcggccatggcgtacgacatcgcggcgatcgagcaccgcgggctcaacgccgtcaccaacttcgacgtcagccgctacatcgactggcaccgccgcctctgccgcgacctcggcgacaacatcatcacacccctaacgaacccaaccgtcgacctcgaggaagccatggccggcgacgacgacgacggccaatttctgctcccgtcccaggcgacgacgccgccgtccacgtcgtccgcgctcggcctgctgctgctgtcgccgaggctcaaggaggtgatcgagggatcaggggccgcgagcgcgatggccgcgtcgacttccgagagcagcgccgccggctcccccccgccgtcttggtcttcgtcttcctgttccccttccccgccctcgccctcgcactcgccgccggagacccagcagaagcagcagcagcaggaatacggcgcttcggctgcggcggcgcggtgcagcttcccggacgacgtgcagacgtacttcgggtgcgaggacggctgcgcggaggtggacaccttcttgttcggggacctgagcgcctacgccgcgcccatgttccagttcgagctgctggacgtttga

SEQ ID NO: 258 - DNA, 1323 bp, Sorghum bicolor
atggccaggccgcgcaagaacgccggtaccgacgaggataatcctaacgccgccacgggcgtcagcgtcaccgggaagccgccgaagctgaagcgggtgcggaggaagggcgagccgcgggagagcagcaccccgtcccagcgcagctccgcgtaccgcggcgtcacacggcaccggtggacggggcggttcgaggcgcacctgtgggacaaggacgcccgcaatggctcccggaacaagaaaggcaagcaaggtgcgtacgacgacgaggaagcggcggcgcgcgcgcacgacctggcggcgctcaagtactggggccccgccaccgtcctcaacttcccgctgtgcggctacgacgaggagctgagggagatggaggcgcagcccagggaggagtacatcgggtcgctgcgtcggcggagcagcggcttctcgcgaggggtgtccaagtacaggggcgttgccaggcatcatcacaacgggcgatgggaggcgaggatcgggcgcgtgctgggcaacaagtacctctacctcggcactttcgcaacgcaagaggaggcggcggtggcgtacgacatcgccgctatagagcaccgtggcctcaacgcggtcaccaacttcgacatcagccactacgtcaatcactggcatcgacactgccacggcccctccgacgacagcctcggcgtggtggtggacgacgtcgccgcgttccagctaccagatgacctgcccgagtgcccggcggccgccatcggcgtcgaggagaccacgggcggcgacgcggaattccacaacggcgaggagggctacctgcagcaccacaccagcggacccttcggcgcgcagcagcagcttcctgacgagacgggagcgctagcggctcatcaaatggcgccaaattcgtcggcgctcgacatggtgttgcagtctcccaagttcaaggagctgatggagcaggtctccgcggcggcggcggcggtggcctccgagagcagcatcggcggcagcatgagcagcagctcgccgtcgccgtctttgtcctcgttctcgccttcgcctctgcagctgccatcgccgtcgtctttgtcctcgttctcgccttcgtcgcctctgcagcagccatcgccgccgctgcagcagcctgagttcgtcgaaggagcgccggcggctcggtgcagcttcccggacgacgtgcagacgttcttcgatttcgagaacgagagcgacatgagcttcatgtacgcggaggttgacacgttcctcttcggggacctgggcgcgtacgcggcgccgatattccacttcgacctagacgtgtga

SEQ ID NO: 259 - DNA, 1532 bp, Zea mays
ccgctgctcaccccgtcctagacgcgaggcgacgacgcctccctatccctctcctccgcaatggccaggccccgcaagaacggcggtaccgacgaggatgatgctaacgccgccacgggagccaccgggaagccgaagaagctgatgaagcgggcgcggaggaagagcgagagcccctccccgcgcagctccgcgtaccgcggcgtcacacggcaccggtggacggggcggttcgaggcgcacctgtgggacaaggacgcccgcaacggctcccggagcaagaaaggcaagcaagtttatctcggcgcgtacgacgacgaggacgcggcggcgcgcgcgcacgacctggcggcgctcaagtactggggccccgccggcaccgtcctcaacttcccgctgagcggctacgacgaggagcggagggagatggaggggcagccccgggaggagtacgtcgcgtcgctgcggcggcggagcagcggcttcgcgcgaggggtgtccaagtacaggggcgttgccaggcatcatcacaacgggagatgggaggcgaggatcgggcgcgtgttaggcaacaagtacctctatctcggcacttacgcaacacaagaggaggcggcagtggcgtatgacatggcggctatagaacaccgcggcttcaacgcggtcaccaacttcgacatcagccattacatcaaccactggcatcgacattgccatggcccctgcgacggcagcctcggcgcgatggacgtcgcaccgaacgtctcgctcgaactagacctactcgagtgcccggccaccgtcggcctcggcctcgaggagaccacgggcgacgatgaattccacaaccgcgaggactacctggggcaccttttcggcgtgcagcagcttcccgacgagatggggccgccggctcatcagatggcaccagcatcgtcggcgctcgatctggtgttgcagtcgcctaggttcaaggagctgatgcaacaggtttccgcggcgggagcctccgagaccaacggcggcagcatgcgtagctcgccatcaacgtccctgtgttcgttctcgccttcgcctctggagctgccatcgccgccgctacagcaacctactgaattcatcgatggcgcgccgccgcggtgcagcttcccggatgacgtgcagtcgttcttcgatttcaagaacgataacgacatgagcttcgtctacgcggaggttgacacattcctcttcggcgacctaggcgcatacgctccgccaatgttcgacttcgacctgtacgagtgatcaggatccgactgccagcgttccaagacgccagtgttgttaaaatggcttcataatttttgtttatgatgatgatgagatgactgctatcaaggtttacttgaaagaggtaggattagttatttattctcgcccttttttcaaatagctagaagaggaaaatatgcttctctttttttcttttttccctaaaaggctcaaaggtgtatacaagtcgtcacgaagaactaattgacattgatgac

SEQ ID NO: 260 - DNA, 977 bp, Arabidopsis lyrata
atcctttattattctcattcaccggtaatggcaaaagtctctcggaggagcaagaaaacaatcgttgaagatgaaatcagcgataaaacagcgtctgcatctgaggctgcgtccattgtctttaaatccaaacgcaaacgtaagtcgccgcctcgaaacgctcctcctcaacgcagctccccttatagaggcgtcacaaggcatagatggactgggagatacgaagcgcatttgtgggataagaacagctggaacgagactcaaaccaaaaaaggacgacaagtttatataggggcttacgacgaagaagaagcagcagcacgtgcctacgacttagcagcattgaagtactggggacgagacacactcttgaacttccctttgctgatttatgacgaagacgtcaaagaaatggaaggccaatccaaggaagagtatattggatcattgagaagaaaaagtagtggattttctcgaggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctgacgccgccgattctaagccaattcgaaacgatcccgaatcgtcggatgataacaaatgtccgaaatcagaggaaataatcgaaccatctacatcgcctgaagctattacaactcgccggagctttcccgacgatatccagacgtattttgggtgtcaagactccggcaagttagcgacggaggaagacgttattttcggtggtttgaattcattcataaatcctggtttctataacgagtttgattatggaccttgatcgtatttctttacaagttttgttttgattatcta

SEQ ID NO: 261 - DNA, 1082 bp, Arabidopsis thaliana
ctctcattttcataattccattttcaggattgtctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgattatctacacaatacatcaaatattatttcttagtgatgatgataacattctatcttaaagctctcaaaaatttctt

SEQ ID NO: 262 - DNA, 1196 bp, Arabidopsis lyrata
attccatcaatttctcatctttgttgttttcctcttctttatgtacatcgccgtcgaagtttctccggtaatggaagagatcacacggaagagcaagaaaacatccgttgagaatgaaaccggcgatgatcagtcagcaacatcagtagtcgttaaagctaaacgtaaacgtcgatcgcaaccacgagacgctcctccacaacgcagctccgtccatagaggcgtcaccaggcatcgatggactggaaggtacgaagcacatttgtgggataagaatagttggaacgagactcagagcaagaaaggaagacaaggggcatatgacgaggaagatgcagcagcacgtgcctacgacttagcagcattgaaatattggggacgagacaccatcttgaatttccctctgtgtaattatgaagaagacatcaaggaaatggaaagccagtcaaaggaagagtatattggatctttgagaaggaaaagtagtgggttctcacgtggtgtatcaaaatacagaggcgttgcaaagcatcaccataatgggagatgggaagctcgaattggaagagtgtttggcaataaatatttataccttggaacttacgctacacaagaagaagcggctatagcgtatgacatcgcagcaatcgagtaccgtggacttaatgccgttactaacttcgacatcagccgttatatgaaactcccggtgccggagaaccctatcgacgccgcgaataatctcctggagagtccgcattctgattccagcccatttataaaccctactcacgagtctgatttatcacagagtcaatcttcctcagacgataacgatgatcggaaaacaaagctcttaaagtcgtcacctttaaatgcagaggaagtaatcggaccatcgacgccaccggagattgctccgcctcgtcggagcttcccggaagatatccagacgtatttcgggtgtcaaaactccggcaagttaacgacggaggaagatgacgttatcttcggtgatttagattctttccttacgcctgatttctacagcgagttaaatgattgctaaagtgttcttctgatttgataagttttgtttttagttttttggaatctcggttgtgaaaatcagcattgacacatatcggttattctttcttgtgacaatcttattataataaagtttgaatcttttt

SEQ ID NO: 263 - DNA, 1114 bp, Thellungiella halophila
gatcgtatatgctcattaaaagtttgaaaccctcttttcaccattgtcgctcctcattcattcttctctcttaccgggaatggcaaaagtctctcagcggagcaagaagacaatcgtcaacgacgaaatcagcgataaaaaagcggttgcggttgcgtctgtgtcttcgtccgctttccttaaatcaaaacgcaaacggaagctgccgccccaaaacgctccacctcaacgcagctcctcctacagaggcgtgacaaggcatagatggacggggagatacgaagcgcatttgtgggataagaactgctggaacgagacgcagaccaagaaaggacgtcaagtttatcttggggcatatgacgaggaagaagcagcagcacgtgcctacgacttagcggcattgaagtactggggacgagacacactcttgaacttccctctacctacttatgaagaagacgtcaaagaaatggaaggccattccagggaagagtacattggatctttgagaaggaaaagtagtgggttttctcgtggtgtatcaaaatacagaggcgttgcaaggcatcaccataatgggagatgggaagctcgaattggaagggtgtttggtaataaatatctataccttggaacatacgcaacgcaagaggaagcagccagagcatatgacatcgcggcaatagagtaccgtggacttaacgccgttaccaacttcgacgtcagccgttatctaaatctaccggaatcgaaaaaccctagcgccgccgcaaatcatctcccggatgaatccgattattacgattctatgcccgttcgaaacccaaaccacgagccaagatcaccagacggtcaaacttcgtcagaggataacgactatacgaaaacagaggagacactcgacccggaagctattccatctcgccggagctttcccgacgatatccagacgtattttgggtgtcaggattccggcaagttagcgacggaggaagacgttattttcggtggttttaattctttcataaatcctggtttctataacgactttgattatgcgccttgatagtgttttgttgaaaagttttttttgtcccgaaaaaaaaaaaaaaaa

SEQ ID NO: 264 - DNA, 1220 bp, Arabidopsis thaliana
attccatcaatttctcatccttgttgttttcttcttcttcttcttcctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctttgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaaaatcaacattgacacatcgattattctttcttgtgacaatcttatataataaagtttgaatctttttaac

SEQ ID NO: 265 - DNA, 900 bp, Glycine max
atggcgaagaaatcacagaaaagcctcaaaaacaacaataacaacaacaccactaggaagcgcacacgcaaaagcgtcccaagagactcacctcctcaacgaagctcaatctataggggtgtcacaaggcatcgatggactggtcgatacgaggctcatttgtgggataagaattgctggaatgaatcacagagcaagaaaggaagacaagtatatctaggggcatatgatgatgaagaagccgcagcacgtgcctatgacttggcagcattgaagtactggggccaagataccattctcaattttccattatcaaattatgaggagaagctcaaggagatggaaggccagtcaaaagaagaatatattggatccttgcgaagaaaaagcagtgggttctctcgaggagtttcaaaatacagaggcgtagcaagacaccaccataacggaagatgggaagctcgaattggaagggtctttggcaacaaatatctataccttggaacttacgctacacaagaagaagcagccgcagcatatgacatggcagcaatagaatacagaggacttaacgccgttacaaactttgacctgagccgttatatcaattggccacgtcctaaaacagaagaaaatcatcaaaatactcctagcaaccaaaatgtaaactctaatgctgaactcgagctaggttcggctagtgacgagatcacagaagagggcgtagcacgatcttcagagtcagagtcaaatccttctcgtcgcacattccctgaagacattcaaacaatttttgaaaataatcaagattcaggcatctacattgaaaatgatgatatcatttttggtgacttgggctcgtttggtgcaccaatttttcatttcgaacttgatgtttag

SEQ ID NO: 266 - DNA, 1186 bp, Brachypodium distachyon
cacaatggcaaagccccgcaagaactccgccgccgccaacaacaacaacaacgacaacagcaccaacgctaacaacgccgtcgccgaggctgcggcggcggatgtgcgcgcgaagccgaagaagcgcacccggaagagcgtgccgcgggagtccccctcgcagcgcagctccatctaccgcggcgttacacggcaccggtggacggggcggttcgaggcgcacctgtgggacaagaacagctggaacgagtcccagaacaagaagggcaagcaagtttacctcggagcatacgacgaggaggaggcagcggcccgggcgtatgacttggcggcattgaaatactggggccccgacaccatcctcaacttcccgctatctgtatacgatgatgagttgaaagaaatggaggggcagtcaagggaagagtatattgggtccctgaggaggaaaagtagcgggttctcaagaggagtctccaagtaccgcggtgtcgccaggcatcaccacaacgggagatgggaggcccggatcggccgtgttttcggcaacaagtatctctacctcggcacctacgcgacgcaggaggaggccgcgatggcgtacgacatggcggcgatcgagtaccgcggcctgaacgccgtcaccaacttcgacctcagccgctacatcaagtggctccgccccggcggcggcgtcgactcggctgccgccgccgccgcccgcaacccgcacccgatgctggccggcctggcgacccaggaggagttaccagcgatcgatcacctcctcgacggcatggcgttccagcagcacggcctccattcttcttcggcggcggcggcagcagcgcaggagttccccctgccgccggcgctcggccacgcccccacgacgtcggcgctgagcctcctgctgcagtcgcccaagttcaaggagatgatcgagcggacgtccgccgcggagacgacgacgacggccacgacgacgtcgtcgtcttcgtccccgcgtccggcggcgtcgccgcagtgcagcttcccggaggacatccagaccttcttcgggtgcgacgacggcgtgggcgtgggagtcggtgcagtgggatacaccgacgtggacggcctcttcttcggggacctctccgcgtacgcgtcgtcgacggcgttccatttcgagctcgacttgtga

SEQ ID NO: 267 - DNA, 1197 bp, Sorghum bicolor
atggcgaagcctcgcaagaacagcgccgccgccaacaacaacaacagcagcagcaacggcgccggcgacctgacgccgcgcgcgaagccgaagcgcacgcggaagagcgtgccccgggagtcccccacgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggaggcagcggcgcgggcgtatgacttggcggcattgaagtactggggccccgacaccatcctcaacttcccggcgtctgcatatgaaggagagatgaaaggaatggagggccagtccagggaagagtatattggatccttgaggaggaaaagcagtgggttctccagaggtgtctccaaataccgaggtgtcgcgagacatcaccacaacgggagatgggaggcgaggatcggtcgtgttttcggaaacaagtatctctacctcgggacttacgcgacgcaggaggaggcggcgatggcgtacgacatggcggcgatcgagtaccgtggcctgaacgccgtcacaaacttcgacctcagccgctacatcaagtggctccgcccgggcgccggcgggatggcagccgcggcggcggcggcgcagaacccgcacccgatgctgggcggcctggcgcagcagctgctgctgccgccgccggcggacaccaccaccaccgacggcgccggcgccgcggcgttccagcacgaccaccacggcgccgaggcgttcccgctgccgcccaggacgtcgctgggccacacgcccacgacgtcggcgctcagcctgctgctgcagtcgcccaagttcaaggagatgatccagcggaccgagagcggcaccaccaccactaccaccacgacatcgtcgttgtcctcgtcgccgccgcccacgccgtccccgtccccgccgcggcggtcgccagcgccgacgcagccgccggtgcaggcggcggccagggacgcctcgccgcaccagcgcggcttccccgaggacgtacagacattcttcggctgcgaggacaccgcgggcatcgacgtggaagccctcttctttggcgacctcgccgcgtacgcgacgccggcgttccacttcgagatggacttgtag

SEQ ID NO: 268 - DNA, 1736 bp, Zea mays
gccggccaatgagatggagcagagcaaagaatttcagagagagagagagagaggagagagaaaggccggcctgtctctcccgtctctcttctttcctcctcctttgctcatttggcatttgccctgctctccaaacatcaactaaatttggccgccccatcaccaatcccttcccagtctctccctccgcgtcgtctttaaaacggccacctccaaaggccccctgtagttggccacccacctctccctcctcctttcttctgtcgtctctctctccgcacgcgcaatggcgaggcctcgcaagaacagcgccgccgccgccaacaacaacaacagcaacaccaccaacgccggcaacgccgccgtcgacctcgcggcgcgcgtcaagccgaagcgcacgcggaagagcgtgccccgggagtccccctcgcagcgcagctccgtctaccgcggcgtcacacggcaccggtggacggggaggttcgaggctcacctgtgggacaagaacagctggaacgagtcccagaacaagaagggcaagcaagtttacctcggcgcgtacgacgacgaggacgcagcggcgcgcgcgtatgacttggcggcattgaagtactggggccccgacaccatcctcaacttcccggcgtctgcatatgaagcagagttgaaagaaatggaggggcagtccagggaagagtatattgggtccttaaggaggaaaagcagtgggttctccagaggtgtttccaaataccgaggtgtcgcaaggcatcaccacaacgggagatgggaggcgaggattggtcgcgtcttcggaaacaagtatctctacctcgggacttacgggacgcaggaggaggcggcgatggcgtacgacatggcggcgatcgagtaccggggcctgaacgccgtcactaacttcgacctcagccgctacatcaagtggctccgcccgggcgccggcgccgcgcagaacccgcacccgatgctggacggcctggcgcagcagctgctgctgtcgccggagggcaccatcgacggcgccgcgttccaccagcagcagcacgaccaccgccagcagggcgccgccgagctcccgctgccgcccagggcgtcgctgggccacacgcccaccacgtcggcgctcggcctgctgctgcagtcgtccaagttcaaggagatgatccagcgggcgtcggcggccgagagcggcaccaccaccgtcaccaccacgtcgtcgtcgtcgtcgcagccgcccacgccgacgccgacgccgtcgccatcgccacctccgacgccgccagtgcagccggccagggacgcctcgccacagtgcagcttccccgaggacatacagaccttcttcggctgcgaggacgtcgcgggcgtcggcgccggcgtcgacgtggacgccctcttcttcggcgacctcgccgcgtacgcgtcgccggcgttccacttcgagatggacttgtagctcatcacacgccattactcgttaatcactatctgggtttttttttttgtcgataggagaatggagctctctcgccatttgagaaccaagaaaatggtgagacacacaaaacaagagaggcagcagaacagacagacggcgcctagtctgttttgagagatttatttacagtggtaactagtgacatttactgaacggttaagattgtattattcaaatttttttcacattggtaacaagggattgtttcatttgtttc

SEQ ID NO: 269 - DNA, 1089 bp, Glycine max
atggccaaaaaatcacagctgcgtacccagaaaaacaatgctactaatgacgatattaatcttaacgcaaccaacactgtaatcaccaaggtgaaacgaacaaggagaagtgtccctagagactccccacctcaacgcagctcaatataccgaggagtcactaggcaccgatggactggccgatacgaagctcatttgtgggacaagcattgctggaatgaatcacagaataaaaaaggacgacaaggcgcttatgataatgaagaggcagcagcacatgcttatgatctagcagcactgaaatactggggtcaagataccattcttaattttccgttatcaaactacctgaatgaactgaaagaaatggagggtcaatcacgggaagagtatatcggatcgctgaggaggaaaagcagtggtttttctagggggatttctaaatacagaggtgttgcaaggcatcatcataacggaaggtgggaggctcggattggcaaagtttttggcaataaatatctttatctcggaacttacgctacccaagaagaagctgctactgcctatgacctggcagctatagaataccgtggactcaatgctgtcaccaatttcgatctcagccgttacattaagtggcttaagcccaacaacaccaacagcaacaatgaccagattagtattaatctcactaacataaataataattgcactaacaacttcatcccaaaccctgatcaagaacaagaagttagtttcttccacaaccaggattcactcaataatactattgtagaggaagccacgttggtgccacatcagcctcgtccagcaagtgccacgttagcattggagcttctacttcagtcatccaagttcaaggaaatggtggaaatgacatccgtggccaatctttcaacacagatggaatctgatcagttgccacagtgcacatttcctgatcacattcagacatactttgagtatgaagattccaataaatatgaggaaggggatgatctcctgttcaagttcagcgagttcagctccattgtgccgttttaccattgtgacgagttcgagagttga

SEQ ID NO: 270 - DNA, 1298 bp, Glycine max
atggccaaaaaatcacagctgcgtacccagaaaaacaatgttaccaccaatgacgataataatcttaacgtaaccaacactgtgaccaccaaggtgaaacgaacaaggagaagtgtccctagagactccccacctcaacgcagctcaatataccgaggagtcactaggcaccgatggacaggccgatacgaagctcatttgtgggacaaacattgctggaatgaatcacagaacaaaaaagggcgacaagtctaccttggcgcttatgacaatgaagaggcagcagcacatgcttatgatctagcagcactgaaatactggggtcaagataccattcttaattttccgttatcaaactacctgaacgaactgaaagaaatggagggtcaatcacgggaggagtatatcggatcgctgaggaggaaaagcagtggtttttctcggggaatttctaaatacagaggtgttgcaaggcatcatcataacggaaggtgggaggctcggattggcaaagtttttggcaataaatatctttacctcggaacttatgctacccaagaagaagctgctactgcctatgacctggcagccatagaataccgtggactcaatgctgtcaccaatttcgatctcagccgttacattaagtggcttaagcctaacaacaacaccaacaacgttatcgacgaccagattagtattaatctcactaacataaacaataataataattgcactaacagcttcaccccaagtcctgatcaagaacaagaagctagcttcttccacaacaaagattcactcaataatactattgtagaagaagtcacgttggtgccacatcagcctcgtccagcgagtgccacgtcagcattggagcttctacttcagtcatcaaagttcaaggaaatgatggagatgacatctgtggccaatctttcatcaacacagatggaatctgagttgccacagtgcacatttcctgatcacattcagacgtactttgagtatgaagattccaatagatatgaggaaggagatgatctcatgttcaagttcaacgagttcagctccattgtgccgttttaccaatgtgacgagttcgagagttgaagaagtcaggtttatataatgcatggaaaaaagaaactctgatatgtttgtttatttgtttaatttgttgattatgttaaagaccatattcataaatctttagctaattaaggtttaagtttttagaagagagatcatgtcattcacaactattataataagtggacttgttttcaatttgtgaa

SEQ ID NO: 271 - DNA, 1160 bp, Medicago truncatula
acctttcaaattaatgcaccattaatactatatataaatatacatctttgctagcttgtttcttcagtatacacttctttttttttccaatggcgaaaaaatcgcagaagcaaatagagaaagacgacaatgcaagcaatgataatgataatctgaatccaagtaacactgtcaccaccaaagcaaaacggacgaggaaaagtgtccctagaacttctccacctcaacgcagctcaatatacagaggagtcactaggcaccgttggacaggccgatatgaagctcatttgtgggacaagaattgttggaatgagtctcagaacaagaaagggagacaaggtgcttatgataatgaggagacggcagcacatgcttatgatctagcagcattgaaatattggggtcaagataccattattaattttccgctatcaaactatcagaaagaactaattgaaatggagagtcaatcaagggaggagtatattggatccttaagaaggaaaagcagtggtttttcacggggtgtatctaaatacagaggtgtagcaagacatcatcataacggaaggtgggaggcacggattggcaaagtttttggcaataagtatctttatctcggaacatatgctacccaagaagaagcagctacagcttatgacatggcagctattgaataccgtggacttaatgctgttaccaatttcgacctaagccgttatattaagtggcttaagcccaacaataacaacaatgacgacaataacaagtctaatattaatctttgtgacattaactctaacagtagtgccaacgactcaaactctaatgaagaattggaatttagcctcgtggacaatgaaatatcactcaataattctattgacgaagccacattggttcaacctcgaccaactagtgccacgtcagccctagagcttttgcttcaatcatctaagtttaaggaaatggtggaaatggcatcaatgacttccaatgtgtcaacgacgttggagtctgatcaattgtcacaatgtgcatttcctgatgacattcaaacgtactttgaatatgaaaatttcaatgatacaatgttggaagacctcaactccattatgcctacgtttcattatgactttgagggtgctgaggttttatag

SEQ ID NO: 272 - DNA, 1044 bp, Glycine max
atggcgaagcagcaaacacacaaaatcaatgcaagcactaacaataacattagcacaactaacactgtcaccgccaaggtgaaacgaacaaggagaagcgtccctagagattccccacctcaacgcagctcaatatacagaggagtcactaggcaccgatggactggccgatacgaagctcatttgtgggacaagaattgctggaatgagtcacagaacaagaaaggacgacaaggtgcttatgacgatgaagaggcggcagcacatgcttacgatctagcagcattgaaatactggggtcaagataccattcttaattttccgttatcgacctaccagaatgaactgaaagaaatggagggtcaatctagggaagagtatattggatcactaaggaggaaaagcagcggtttttctcgtggagtttctaaatacagaggtgttgcaagacaccatcataacggaagatgggaggctcggattggcagggttttcggcaacaaatatctttacctcggaacttacgcaacccaagaagaagctgccacagcatatgacatggcagctattgaatatcgaggagtcaacgctgtgaccaatttcgacctcagccgctatatcaagtggcttaagcccaataataacaacaccacagtcaactctaatcttattgactctaaccctaattgtgagacgaactttacctcaaactctaatcaacaacaaggattcaattttttcaacagacaagagtcattcaataatgaagaagcggcaatgactcagcctcggccagctgttgccacgtcagccctaggacttttgcttcagtcatccaagtttaaggaaatgatggagatgacttctgctacagatttgtcaacaccgccgtcggagtctgagttgccgtcatgcacatttcccgatgacattcaaacatattttgagtgtgaagattcccatagatatggagaaggggatgatattatgttcagcgtgctcaacggctttgtgccccctatgttccattgtgatgacttttga

SEQ ID NO: 273 - DNA, 1056 bp, Glycine max
atggcgaagcagcaaacacacgaaatcaatgcaagcactaacaataacattaacacaactaaaactgtcaccaccaaggtgaaacgaacaaggagaagtgtccccagaaattccccacctcaacgcagctcaatatacagaggagtcactagacaccgatggacaggtcgatacgaagctcatttgtgggacaagaattgctggaatgagtcacagaacaagaaaggacggcaaggtgcttatgacgatgaagaggccgcagcacatgcttatgatctagcagcattgaaatactggggtcaagataccattcttaattttccgttatcgacctaccagaatgaactgaaggaaatggagggtcaatctagggaagagtatattggatcactaaggaggaaaagcagcggtttttctcgtggagtttctaaatacagaggtgttgcaagacaccatcataacggaagatgggaagctcggattggcagggttttcggcaacaaatatctttacctcggaacttatgcaacccaagaagaagctgccacagcatatgacatggcagctattgaatatcgaggactcaacgctgtgaccaattttgacctcagccgctatatcaagtggcttaagcccaataacaacaataacaaagtcaattctaataatcttattgtctctatccctaattgtgcgaccaactttaccccaaactctaaccaacaacaaggattcaattttttcaacagtcaagaatcattcaataataatgaagaagcggcaatgactcagcctcggccagctgctgccacgtcagccctaggacttttgcttcaatcatccaagtttaaggaaatgatggagatgacttctgccatagatttgtcaacaccgccatcagaatctgagttgccgccatgcacatttcccgatgacattcaaacatattttgagtgtgaagattcccatagatatggagaaggggatgacatcatgtttagcgagctcaacggctttgtgccccctatgttccattgtgatgactttgaggcttga

SEQ ID NO: 274 - DNA, 1062 bp, Populus trichocarpa
atggcgaaattatcacagaagaacacaaaaaacacagcaagtaacaataataacacgactaatggcgtgaccaaggtgaaacgaacaaggagaagtgttccaagagactctcctcctcaacgcagctccatttatcgtggcgttactaggcaccggtggaccggccgatatgaagctcatttgtgggataagaattgctggaatgaatcacagaacaagaaaggacgacaaggtgcctatgatgatgaagaagcggcagcgcatgcttatgacttagcagcactgaagtactggggtcctgagacaattcttaattttccgttgtcgacataccaaaatgaactgaaagaaatggagggtcagtcgagagaagagtgcattggatcattgagaaggaaaagcagtggcttttctcgtggagtttcaaaataccgaggagttgctaggcatcatcacaacgggaggtgggaagctcggattggtagagtattcggcaacaaatacctatatctcgggacatatgctactcaagaagaagctgccaccgcttacgatatggcggctatagagtaccgtggcctgaatgctgttaccaacttcgatcttagccggtacatcaaatggctaaaacccaatcaaaataacactgataacaataatggtctggatctccctaaccctatcataggcactgataattcaactcatcctaaccctaaccaagagcttggaacaaccttccttcaaattaaccagcaaacctaccaacctagtgaaactacattaactcaaccacggccagcaacgaatccttcatctgccctagggctcttacttcaatcatcgaagttcaaggagatgatggaaatgacagcagtgacagattgcccaccaaccccaccgtcgggcttagacccgacaccatgtagcttccttgaagacgtgcagacatattttgactgtctcgattcaagtaactacggggatcaaggtgacgacatgatttttggcgacctcaactcgtttgtgccacccatgttccagtgcgatttcgagacataa

SEQ ID NO: 275 - DNA, 1044 bp, Vitis vinifera
atggcgaagctatcacagcaaaaccataagaatagtgcaaacagcaatgctactaatactactctctctgtgacaaaggtgaagcggactcgcaaaactgtccccagagactctcctcctcagcggagctcgatatatcggggcgtcacgaggcatcggtggactggccgatacgaggctcatttgtgggataagaactgctggaatgaatcacagaacaagaaaggaagacaaggtgcctaccatgatgaagaagccgcagcacatgcttatgacttggcagctctcaaatactggggtccagaaaccattctcaattttccgctatcaacatatgaaaaggagttgaaggaaatggagggtctgtcaagagaagaatacattggatccttgagaagaagaagcagcggtttttctcgaggtgtttcaaaatatagaggggttgcaagacatcatcacaatggcagatgggaagcgcggattggcagagtgttcggcaacaaatacctctatcttggcacatatgctactcaggaggaggcagcgactgcatatgatatggctgccatagagtatcgcggtcttaacgcggttaccaactttgatctcagtcgctacatcaaatggttaaagcctaatcaaaataacccatgcgaacagcccaataaccctaaccttgactctaatttgactccaaaccctaatcatgattttggaatcagcttcctgaatcacccacagacttctggtactgctgcctgcagtgaacctccattgactcagaccaggcctcccattgcctcatcggcgcttggccttctacttcagtcctcaaagttcaaagagatgatggagatgacaactgccgccgaccacctatcgacaccgcctgagtctgagctgccacggtgcagcttccctgacgacattcagacgtacttcgagtgccaggattccggcagttacgaggaaggagacgatgttatcttcagtgagctcaactcgttcatacctcccatgttccaatgtgatttcagtgcttaa

SEQ ID NO: 276 - DNA, 828 bp, Populus trichocarpa
atgggaaaaacatcaaagcaaagcctaaagaactctgcaaacactagcattaatcccgcaaccaaggtgaagcggactagaaagagtgttcctcgagactctcctcctcaacgcagctccatctatagaggcgttacaaggcatcgatggaccggacgttatgaggctcatttgtgggataagaactgctggaatgagtcacagaacaagaaaggaagacaaggggcctacgatgacgaagaagcggctgggcatgcctatgacttggcagcattaaagtactggggacaggatactatcctcaattttcctctgtcaacttacgaagaagaattcaaagagatggagggtcattcgaaagaagaatatattggatcactgaggagaaaaagtagtgggttttcacgcggtgtgtccaaatatagaggtgtagccagacaccatcataatggaagatgggaagctcgaattggcagagttttcggcaacaagtacctctaccttggaacatatgccactcaagaagaagcagcaacagcatatgacatggcagctatagagtaccgtggacttaatgctgtgacaaactttgacctaagccgctactcctcaaagttcaaggaaatgttggagagaacatcagcttctgattgccctttgacaccacccgaatccgaccgcgatccgcctcgtaggagcttcccagatgacatccaaacttacttcgattgccaagactccagtagctacactgatggtgatgacattatttttggagacctacattcatttgcttcaccgatttttcattgcgaattggatgggtag

SEQ ID NO: 277 - DNA, 943 bp, Lupinus angustifolius
tggcaaataatgatttttattttgactgatagtgacctgttcgttgcaacaaattgatgagcaatgcttttttataatgccaactttgtacaaaaaagttggtgaggcacatctttgggataaaagtacatggaaccaaaatcagaataagaaaggaaagcaagtttacttgggggcatatgatgatgaggaagcagcagctagagcatatgaccttgctgctctgaagtattggggtccagggactctcattaatttcccagtgactgattatacaagagatcttgaagaaatgcagaatgtttcgagagaggaataccttgcatctttacggcggaagagcagtggtttttcaagaggaatatcaaaatatcgtgcactctccagtcgatgggagccatcatatagtcgttttgctggatctgactacttcaacagtatgcattatggcgcaggtgatgattcagccgcagaaaaagaaaagagacatggtttcgctggagatatttgcagcgaacttaaaacgctggaacagaaagtccaacctactgaaccataccagatgccagagttaggcaggtcccacaatgagaaaaaacatagaagttctgccgtctctgccttaagtatcttgtcgcaatctgctgcttataagagcttgcaagagaaagcatcaaagaaacaggaaaatagcatcgataatgatgagaatgaaaacaaaaatacagtcaataagttggattatggcaaagcagttgagaaatcatcaatcatgacagtgacagtgatcgacttgacattgcaatgggaacagttgtgccattgtgtctcaaagaaatgttttatccatcgatccgttcttgtctgcacgcttttgactgcatacgatactcgttgatccatcatggtaagatcctgtttttgtgagacgtcctcatgggcc

SEQ ID NO: 278 - DNA, 1729 bp, Lupinus angustifolius
cgactctatacgatacaaaacatactctgattttctctctcttagcgttagggtttcgttttcaataaccatggcttcttcttcttccgatcccggtaagtccgaaattggtggcggtgcggcggagacttcggaagctgcggcggtggcggtggcggtgacgaacgaccaatcgttattgtacaggggattgaagaaagcgaagaaagagagaggttgtactgcgaaagaacgcatcagcaaaatgcctccttgtgccgctggaaaacgcagctccatataccgtggagttaccaggcatagatggactggtcgctatgaggcacatcttagggataaaagtacatggaaccaaaaccagaataagaaaggaaagcaagtttacttgggggcatatgatgatgaggaagcagcagctagagcatatgaccttgctgctctgaagtattggggtccagggactctcattaatttcccagtgactgattatacaagagatcttgaagaaatgcagaatgtttcgagagaggaataccttgcatctttacggcggaagagcagtggtttttcaagaggaatatcaaaatatcgtgcactctccagtcgatgggagccatcatatagtcgttttgctggatctgactacttcaacagtatgcattatggcgcaggtgatgattcagccgcagaaagtgagtatgcaagtggtttctgtatagaaagaaagattgatttaactggtcacattaaatggtggggatctaataaaagtcgtcaacctgatgctggaacgagattatcagaagaaaagagacatggtttcgctggagatatttgcagcgaacctaaaacgctggaacagaaagtccaacctactgaaccataccagatgccagagttaggcaggtcccacaatgagaaaaaacatagaagttctgccgtctctgccttaagtatcttgtcgcaatctgctgcttataagagcttgcaagagaaagcatcaaagaaacaggaaaatagcaccgataatgatgagaatgaaaacaaaaacacagtcaataagttggatcatggcaaagcagttgagaaatcatcaaaccacgatggtggcagtgatcgtgttgacattgaaattggaacaactggggcattgtctcttcaaagaaatatctacccactgacgccattcttgtctgcaccgcttttgacagcatacaatactgttgatccatcattggtagatcctgttctatggacatctcttgtgcctatgctttctgctggcctttcttgtcctactcaggttacaaagactgagaccagttcatcttacaccatctttcagcctgagggatgatgtggacattcgattatctgacagtagaaaaggcaaacacctgaaagagctgaactcctatatcaaacagcaacataagcatctgcatctgaactctgaagaactcaagcaggtatgagagaatgctcccatggctttttttttgcaagcttacatgggttttagaggccagagaaaagaaagtagtattactgtgttttaaatgataatatatatacaggaatagcataaatcttttcaagccatacatacatgtgtatcagttgatatcaccaatagaaaattctgtacagagcaagatgtgaaattatgcaagaatatgtttattaatttatttgcataggagtttttgaggtcctaaaaaaaaaaaaa

SEQ ID NO: 279 - protein, 356 aa, Arabidopsis thaliana
MDWEIRGSSLGQKLLEFDSEQERQTRFRAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 280 - protein, 430 aa, Arabidopsis thaliana
MKKRLTTSTCSSSPSSSVSSSTTTSSPIQSEAPRPKRAKRAKKSSPSGDKSHNPTSPASTRRSSIYRGVTRHRWTGRFEAHLWDKSSWNSIQNKKGKQVYLGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQANHQEGILVEAKQEVETREAKEEPREEVKQQYVEEPPQEEEEKEEEKAEQQEAEIVGYSEEAAVVNCCIDSSTIMEMDRCGDNNELAWNFCMMDTGFSPFLTDQNLANENPIEYPELFNELAFEDNIDFMFDDGKHECLNLENLDCCVVGRESPPSSSSPLSCLSTDSASSTTTTTTSVSCNYLV

SEQ ID NO: 281 - protein, 430 aa, Arabidopsis lyrata
MKRRLTTSTSSSSPSSSVSSSTTTSSPIQSEAPRPKRAKRAKKSSPSGDKSHNPTSPASTRRSSIYRGVTRHRWTGRFEAHLWDKSSWNSIQNKKGKQGAYDSEEAAAHTYDLAALKYWGPDTILNFPAETYTKELEEMQRVTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVNQPNHQEAILVEAKQEIETREAKEEPREEVKQQYVEEPPQEEKEEEKAEQQEAEFVGYKDEGAVVNCCIDSSAIMEMNRCGDNNELAWNFCMMDSGFAPFLTDQNLSNENPIEYPELFNELAFEDNIDFMFDEAKNDCLSLENLDCCVVGRESPTSSSSPLSCFSTDSASSTTTTTSVSCNYLGLFVGSE

SEQ ID NO: 282 - protein, 413 aa, Brassica napus
MKRPLTTSPSSSSSTSSSACILPTQSETPRPKRAKRAKKSSLRSDVKPQNPTSPASTRRSSIYRGVTRHRWTGRYEAHLWDKSSWNSIQNKKGKQVYLGAYDSEEAAAHTYDLAALKYWGPNTILNFPVETYTKELEEMQRCTKEEYLASLRRQSSGFSRGVSKYRGVARHHHNGRWEARIGRVFGNKYLYLGTYNTQEEAAAAYDMAAIEYRGANAVTNFDIGNYIDRLKKKGVFPFPVSQANHQEAVLAETKQEVEAKEEPTEEVKQCVEKEEAKEEKTEKKQQQEVEEAVITCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTATTVTSVSWNYSV

SEQ ID NO: 283 - protein, 415 aa, Brassica napus
MKRPLTTSPSTSSSTSSSACILPTQPETPRPKRAKRAKKSSIPTDVKPQNPTSPASTRRSSIYRGVTRHRWTGRYEAHLWDKSSWNSIQNKKGKQVYLGAYDSEEAAAHTYDLAALKYWGPDTILNFPAETYTKELEEMQRCTKEEYLASLRRQSSGFSRGVSKYRGVARHHHNGRWEARIGRVFGNKYLYLGTYNTQEEAAAAYDMAAIEYRGANAVTNFDISNYIDRLKKKGVFPFPVSQANHQEAVLAEAKQEVEAKEEPTEEVKQCVEKEEPQEAKEEKTEKKQQQQEVEEAVVTCCIDSSESNELAWDFCMMDSGFAPFLTDSNLSSENPIEYPELFNEMGFEDNIDFMFEEGKQDCLSLENLDCCDGVVVVGRESPTSLSSSPLSCLSTDSASSTTTTTITSVSCNYSV

SEQ ID NO: 284 - protein, 285 aa, Glycine max
MKRSPASSCSSSTSSVGFEVHHPIEKRRPKHPRRNNLKSQKCKQNQTTTGGRRSSIYRGVTRHRWTGRFEAHLWDKSSWNNIQSKKGKQVYLGAYDTEESAARTYDLAALKYWGKDATLNFPIETYTKDLEEMDKVSREEYLASLRRQSSGFSRGISKYRGVARHHHNGRWEARIGRVCGNKYLYLGTYKTQEEAAVAYDMAAIEYRGVNAVTNFDISNYMDKIKKKNDQTLQQQQTEVQTETVPNSSDSEEAEVEQQHTTTITTPPPSENLHMLPQEHQVGGWV

SEQ ID NO: 285 - protein, 417 aa, Jatropha curcas
MKRSSASSCSSSSSSSSSPSSSSSSACSASSSCLDSVSPPNHHQLRSEKSKSKRIRKIQTKQDKCQTTATTTSPSGGGRRSSIYRGVTRHRWTGRFEAHLWDKSSWNNIQNKKGRQVYLGAYDNEEAAAHTYDLAALKYWGQDTTLNFPIETYSKELEEMQKMSKEEYLASLRRRSSGFSRGVSKYRGVARHHHNGRWEARIGRVFGNKYLYLGTYNTQEEAAAAYDMAAIEYRGANAVTNFDVSHYIDRLKKKGIPLDKILPETLSKGSKESEEIERTSPLPLPSPPSPSITPLHEEIVSPQLLETECPQHPPCMDTCTMIVMDPIEEHELTWSFCLDSGLVPLPVPDLPLANGCELPDLLDDTGFEDNIDLIFDACCFGNDANPADENGKERLSSASTSPSCSTTLTSVSCNYSV

SEQ ID NO: 286 - protein, 443 aa, Ricinus communis
MKRSPTSPCSSSSSSSYSSSSASSSCVGPDDTPVAPGSHHHHDHHQLRSQKSSKRIRKVKKKQQNHNIDQNNTNTTITAPTSARRSSIYRGVTRHRWTGRFEAHLWDKSSWNNIQNKKGRQGAYDNEEAAAHTYDLAALKYWGPETTLNFPIETYPKELEEMQKMSKEEYLASLRRQSSGFSRGVSKYRGVARHHHNGRWEARIGRVFGNKYLYLGTYNTQEEAAAAYDMAAIEYRGANAVTNFDISNYIDRLKKKGILLDQILPDQPLRKCSSESEEAEAEAEVERLPSLPSSILPQEQDTISPQLQCTQLLPSMDSCTMINMDPIEDNELTWSFCLDSGLTLFSVPELPLENACELPDLFDDTGFEDNIDLIFDGCCFGNDDDGGGGANHQEFMVESRGCRVGEVGISGSMEEENGKEMCCSSSSPSCSTTTSVSCCNYSV

SEQ ID NO: 287 - protein, 402 aa, Populus trichocarpa
MKRSSSCSSSSSSSSSSCVASESIHKPKAKRIRKNQKSNQGKSQNAAAAAANNSHNSGKRSSIYRGVTRHRWTGRFEAHLWDKSSWNSIQNKKGKQGAYDNEEAAAHTYDLAALKYWGSETTLNFPIETYTKEIEEMQKVTKEEYLASLRRQSSGFSRGVSKYRGVARHHHNGRWEARIGRVYGNKYLYLGTYNTQEEAAAAYDMAAIQYRGANAVTNFDVSNYIERLRKKGIPIDRILQEQQLLNNSVDSSVEVEVEQPTPPPQQQQEEQEQKIVSSSSQLQCSQLNSSLDGTPPMVIMDTIEEHELAWSFCMDSGLSLTMPDLPLENSCELPDLFDHTGFEDNIDLIFDACCYGKEANPAGYTLEDNSTGGVEEDRLSSDSVSNSPTSSTTTSVSCNYSV

SEQ ID NO: 288 - protein, 409 aa, Vitis vinifera
MVKRSSPGSSSSPSSSSTSSDAASRPAPPSGGKPKSRKKEAKKNSNGNGSNSKNKRTSIYRGVTKHRWTGRFEAHLWDKSSWNDISNKRGRQGAYYNEEAAARTYDLAALKYWGPTTPLNFPLETYQKDAEEMEKMSKEEYLALLRRQSNGFSRGVSKHHHNGRWEARIGRVLGNKYLYLGTYSTQEEAAAAYDMAAIEYRGLNAVTNFDISNYVKLGRVEAQVQELAQQLQPNTPIGPQNELQKEEEEQLQEPVLSSSQHLPSMDSSAMEIMDPADDPDLPWNFCAYSTLLVPDVPLGKGGELSDLFYEKGFEDNIDYMFEGAAGNEEESNSAENGVKENGFMHELEVDGKLQNVVGFFFLSFFFLPKRAGIRKRGVDSCMQLFLYFVFLFYPFLPEVSKFLFHLSLD

SEQ ID NO: 289 - protein, 420 aa, Brachypodium distachyon
MKRSPPQPSPSPSSSPASSSSSPSSSDSSSSIAIPRKRARTAAAAAGGGKARAAAAKRPKKDGKDSGSSSNGGGGGGGKRSSIYRGVTRHRWTGRFEAHLWDKNCFTSLQNKKKGRQVYLGAYDTEEAAARAYDLAALKYWGPETTLNFSADDYGKERSEMEAVSREEYLAALRRRSSGFSRGVSKYRGVARHHHNGRWEARIGRVLGNKYLYLGTFDTQEEAARAYDLAAIQYRGANAVTNFDISRYLDQPQLLEQLQQQQGPQVVAALQEEAQRDHQSDNAVQELNSGEAQTPGGIDEPIAIGDSTEDINTSLTVDDIIEESLWSPYEFDIMAGVNVSNSMNLSELFSDVAFEGNIGCLFEECSGIDDCSSRHGAGLAAFGLFTEGDDKLKDVSEMEMEVNPQANDVSCPPKMITVCN

SEQ ID NO: 290 - protein, 423 aa, Hordeum vulgare
MKRSPPPQPSPSSSPACSPSPSSPSSSDSSSIAIPRKRARTQKAGSAKAKAAPKRAKKDSGRSTKDSDASANGAAASGKRSSIYRGVTRHRWTGRFEAHLWDKNCFTSIQNKKKGRQVYLGAYDTEEAAARAYDLAALKYWGPETTLNFTVDEYAKERSEMEAVSREEYLAALRRRSSGFSRGVSKYRGVARHHHNGRWEARIGRVLGNKYLYLGTFDTQEEAARAYDLAAIEYRGANAVTNFDISRYLDQPQLLAQLEQGPQVVPALQEELQHDHQSDNAVQELNSGEAQKPGSVSEPIAVDDTDNTGDIGAPLVFDSGVEENLWSPCMDYDVDPIFGPNISSSMNLSEWFNDPAFESNIGYMFEGCSDVDDCSTRHGAGLSALGFLKEGDDKLKDGSDMEAEITPQANDVSCPPKMITVCN

SEQ ID NO: 291 - protein, 443 aa, Oryza sativa
MAKRSSPDPASSSPSASSSPSSPSSSSSEDSSSPMSMPCKRRARPRTDKSTGKAKRPKKESKEVVDPSSNGGGGGKRSSIYRGVTRHRWTGRFEAHLWDKNCSTSLQNKKKGRQGAYDSEEAAARAYDLAALKYWGPETVLNFPLEEYEKERSEMEGVSREEYLASLRRRSSGFSRGVSKYRGVARHHHNGRWEARIGRVLGNKYLYLGTFDTQEEAAKAYDLAAIEYRGANAVTNFDISCYLDQPQLLAQLQQEPQLLAQLQQEPQVVPALHEEPQDDDRSENAVQELSSSEANTSSDNNEPLAADDSAECMNEPLPIVDGIEESLWSPCLDYELDTMPGAYFSNSMNFSEWFNDEAFEGGMEYLFEGCSSITEGGNSMDNSGVTEYNLFEECNMLEKDISDFLDKDISDFLDKDISISDGERISPQANNISCPQKMISVCN

SEQ ID NO: 292 - protein, 420 aa, Sorghum bicolor
MDMERSQQQKSPTESPPPPSPSSSSSSVSADTVLPPPGKRRRAATTAKAKAGAKPKRARKDAAAAADPPPPPAAAAAGKRSSVYRGVTRHRWTGRFEAHLWDKHCLAALHNKKKGRQVYLGAYDSEEAAARAYDLAALKYWGPETLLNFPVEDYSSEMPEMEGVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEAQPDQSETETIAQESVSSEAKTPDDNAEPDDNAEPDDIAEPLITVDDSIEESLWSPCMDYELDTMSRSNFGSSINLSEWFNDADFDSNIGCLFDGCSAVDEGGKDGVGLADFSLLEDFSLFEAGDGQLKDVLSDMEEGIQPPTMISVCN

SEQ ID NO: 293 - protein, 395 aa, Zea mays
MERSQRQSPPPPSPSSSSSSVSADTVLVPPGKRRRAATAKAGAEPNKRIRKDPAAAAAGKRSSVYRGVTRHRWTGRFEAHLWDKHCLAALHNKKKGRQVYLGAYDSEEAAARAYDLAALKYWGPETLLNFPVEDYSSEMPEMEAVSREEYLASLRRRSSGFSRGVSKYRGVARHHHNGRWEARIGRVFGNKYLYLGTFDTQEEAAKAYDLAAIEYRGVNAVTNFDISCYLDHPLFLAQLQQEPQVVPALNQEPQPDQSETGTTEQEPESSEAKTPDGSAEPDENAVPDDTAEPLSTVDDSIEEGLWSPCMDYELDTMSRPNFGSSINLSEWFADADFDCNIGCLFDGCSAADEGSKDGVGLADFSLFEAGDVQLKDVLSDMEEGIQPPAMISVCN

SEQ ID NO: 294 - protein, 413 aa, Brachypodium distachyon
MEAYCSTLVKDELINGGGGGSAGGMRYCEAAPRVSPPVAIKSVKRRKREPPAVSGMTTVSGGGKDGDKSAGNAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSTINTNTPAAELAILGGGGTPAALITPPPTMHVPRLLPPLVKGRGSSIADDVSAGSCVFGGPSPSPSPTTTALSLLLRSSVFQELVAQQQPPSTVDDDDDIGGHAAVSDAAQRAAEENEESFGEVLYGAGEGEAATAFSCSMYELGLDDNFARIEESLWGCL

SEQ ID NO: 295 - protein, 423 aa, Brachypodium sylvaticum
MEAYCSSLVKDELINGGGGGAGGMRYCEAAPRVSPPVAIKSVKRRKREPPAVSGMTTVSGGGGGNGKDGDKSAGNAAAAKRSSRFRGVSRHRWTGRFEAHLWDKGTWNPTQKKKGKQVYLGAYNEEEAAARAYDLAALKYWGPTTYTNFPVVDYEKELKVMQGVSREEYLASIRRKSNGFSRGVSKYRGVARHHHNGRWEARIGRVFGNKYLYLGTYSTQEEAARAYDIAAIEYRGINAVTNFDLSSYIRWLKPNSAANTNTPPAAAAELAILGGAPAALISPAPAPTTMRVPRLLPPLVRGRGGSIPDDVSAGGSCVFGSPSPSPSPTTTSALSLLLRSSVFQELVAQQQPPSIVDDDDGVGGQEAVSDAAERAAEENEESFGEVLYGAGEGEAAAAFSCSMYELGLDDSFARIEESLWGCL

SEQ ID NO: 296 - protein, 399 aa, Oryza sativa
METYGLVKDELLHGIGGGQGRLYCEVKPTAAPAVITAAGGGAKSVKRRKREPSAAAMSAVTVAGNGKEAGGSNAANKRSSRFRGVSRHRWTGRFEAHLWDKGTWNPTQKKKGKQVYLGAYNEEDAAARAYDLAALKYWGPTTYTNFPVADYEKELKLMQGVSKEEYLASIRRKSNGFSRGVSKYRGVARHHHNGRWEARIGRVFGNKYLYLGTYSTQEEAARAYDIAAIEYRGINAVTNFDLSTYIRWLKPPSSSSAAGTPHHHGGGMVVGADRVLAPAQSYPISAAADDDVAGCWRPLPSPSSSTTTALSLLLRSSMFQELVARQPVVEGDDGQLAVVSGDDADADADSDVKEPPPESEYGEVFASDEAAAAAAYGCSMYELDDSFALIDDSVWNCLI

SEQ ID NO: 297 - protein, 488 aa, Sorghum bicolor
METYSLQVKDELHGGGIGIGGGGQGLYCGATPRPAAPAATGGGGGGGDGAVKSNKRSRKREPPPPPPSSLVTMSNGGKDEAVAGSGDKSASSNSNASKRSSRFRGVSRHRWTGRFEAHLWDKGTWNPTQKKKGKQVYLGAYNEEDAAARAYDLAALKYWGPTTYTNFPVVDYERELKVMQNVSKEEYLASIRRKSNGFSRGVSKYRGVARHHHNGRWEARIGRVFGNKYLYLGTYSTQEEAARAYDIAAIEYRGINAVTNFDLSTYIRWLKPGGGVEDSAAGTPTSGVRAPGIPPASLSLQAGGLLQHPHGAAAGMLQVDVDDLYRGQLAAARGAALFSGGIDDVGSVYAAGSAGPSPTALCAGRPSPSPSPSSSTTALSLLLRSSVFQELVARNAGGGAAQQQQLVVADDDGAVSPADVVDAKVEQPEAEGELGRHGDQLYGAARADEDEDAFACSMYELDDSFARMEQSLWGCLRSSDAPDNMNNL

SEQ ID NO: 298 - protein, 443 aa, Sorghum bicolor
MESSGMMMVKSEIESCGYPGPSSSTAPAAGVVIGGSATTERGEGGHHHHHHQVVVRRRRREPPLLAPIAGGGIGKPLPSITVKRSSRFRGVSRHRWTGRFEAHLWDKNSWNPTQRKKGKQVYLGAYDEEEAAARAYDLAALKYWGPTTYTNFPVMDYEKELKIMENLTKEEYLASLRRKSSGFSRGVSKYRGVARHHQNGRWEARIGRVFGNKYLYLGTYSTQEEAARAYDIAAIEYKGVNAVTNFDLRSYITWLKPSGAPAAFNPEAALLMQAAPAEQLLHPAETAQMLPRVGNPFLLDHGAAPPGSSGGGGQDASMSSMVSPGAGGGMRRRGSSTALSLLLKSSMFRQLVEKNSDAEEGVRDREDAAAAAAAAHPAGPGDAYEYHNFFQGEAPPDMCDLFSSGGGGDHARNAGFHGEIAACYDDGEGLDGWNGFGNMSSLQ

SEQ ID NO: 299 - protein, 407 aa, Glycine max
MELAPVKSELSPRSHRLLMIDGSEVIGTKCVKRRRRDSSTAVLGGNGQQGEQLEEQKQLGGQSTATTVKRSSRFRGVSRHRWTGRFEAHLWDKGTWNPTQKKKGKQVYLGAYNDEEAAARAYDLAALKYWGISTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQPFATSNSMQARGNIEVSNSNKNSFPSGKLDSTKKRDFSKYMNPLSPCNKPSSPTALGLLLKSSVFRELMQRNLNSSSEEAEEVELKYPHEGNDGVGGIYDNENTNNSYFCSSNISRLPNLESSEESPLPMYHGTVQSLWNSAFNMSN

SEQ ID NO: 300 - protein, 406 aa, Glycine max
MELAPVKSELSPRSHRLVIIDGSDVISTKCAKRRRRDSSMAVLGGNGQQGEQLEEQKQLGGQSTATTVKRSSRFRGVSRHRWTGRFEAHLWDKGTWNPTQKKKGKQVYLGAYNDEEAAARAYDLAALKYWGTSTFTNFPVSDYEKEIEIMKTVTKEEYLASLRRRSSGFSRGVSKYRGVARHHHNGRWEARIGRVFGNKYLYLGTYSTQEEAARAYDIAAIEYRGINAVTNFDLSTYIRWLRPGTHPTASHDQKPSTDAQLFATSNSMQTRGNIEVSNSNMHSFPSGELDSTKKRDFSKYMNPLSPCNKPSSPTALGLLLKSSVFRELMQRNLNSSSEEADVELKYPQEGNDGVGGIYDNDNTSNSYFCSSNISRLPNLESSEECPLPMYHGTMQSLWNSAFNMSN

SEQ ID NO: 301 - protein, 418 aa, Populus trichocarpa
MEMTRNTGDQISLGRRRLCMIEEERRAGEAGKCIKRRRRDPSTFALSCNINDQQSDQQQQQQSLGDRTAAVATTVKRSSRFRGVSRHRWTGRFEAHLWDKGTWNPTQRKKGKQGAYDEEESAARAYDLAALKYWGTSTFTNFPASDYEKEIEIMKTVTKEEYLASLRRRSSGFSRGVSKYRGVARHHHNGRWEARIGRVFGNKYLYLGTYSTQEEAAHAYDIAAIEYRGINAVTNFDLSTYIRWLKPEASLPAPQTQESKPASDPLPMATFSNHLPSEKPTQLSVLQMDPSLMDNLNTPKNEDIFHRKTLPVSPLTRSSSSTALSLLFKSSIFKELVEKNLNTTSEEIEENDSKNPHNGNNNAGEAFYDGLSPIPHTGTSTEDPFLCSEQGETNTLPPYSGMEQSLWNGALSMPSRFH

SEQ ID NO: 302 - protein, 336 aa, Vitis vinifera
MEMTTVKSELGLERGRLCTAETDALEVTKCVKRRRRDPSAVTPGCSKQGEQQKQVLLQAGQSITAIATTMKRSSRFRGVSRHRWTGRFEAHLWDKGSWNVTQRKKGKQVYLGAYDEEESAARAYDLAALKYWGPSTFTNFPVSDYEKEIEIMQGLTKEEYLASLRRRSSGFSRGVSKYRGVARHHHNGRWEARIGRVFGNKYLYLGTYSTQEEAAHAYDIAAIEYRGINAVTNFELSTYVRWLRPRATALTPQEPRSNSIMQASSNCLPNEEVELSFLSPNPFTVDDLATPLKQEKFQREVSISPCTKSSSPTALSLLHRSSVFRQLVEKNSNSIE

SEQ ID NO: 303 - protein, 389 aa, Glycine max
MAMMKENIIEVSLGRRQMSMTEGEFQGTRSVKRRRREVAAAAGSGDDNHQQQLPQQEVGENTTVNTTKRSSRFRGVSRHRWTGRYEAHLWDKLSWNITQKKKGKQGAYDEEESAARAYDLAALKYWGTSTFTNFPISDYEKEIQIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTLEANLESHAALEHQKVASPSNYALTEESKSLALHNSFFSPYSLDSPVKHERFGNKTYQFSSNKSSSPTALGLLLRSSLFRELVEKNSNVSGEEDDGEATKDQQTQIATDDDLGGIFFDSFSDIPFVCDPNRYDLELQERDLHSIF

SEQ ID NO: 304 - protein, 389 aa, Glycine max
MVMMKENIIEEKLGRSQMSMVEGEFQGTWGVKRRRREVAAAASSGDDNHHQQLPQQEVGENSSISTTKRSSRFRGVSRHRWTGRYEAHLWDKLSWNITQKKKGKQGAYDEEESAARAYDLAALKYWGNSTFTNFPISDYEKEIEIMQTMTKEEYLATLRRKSSGFSRGVSKYRGVARHHHNGRWEARIGRVFGNKYLYLGTYSTQEEAARAYDIAAIEYRGIHAVTNFDLSTYIKWLKPSGGGTPEENLESHAVLEHQKLASPSNYALTEESKSLVLPNSFISPDSLDSPVKHESFGNKTYQFSRNKSSSPTALGLLLRSSLFRELVEKNSNVSGEEADGEVTKDQQPQLASDDDLDGIFFDSFGDIPFVCDPTRYNLELQERDLHSIF

SEQ ID NO: 305 - protein, 392 aa, Medicago truncatula
MAMLIENEVMCLGKSQRSMDGKEVKGARRVKRQRRDAIVPKIGDDANKMAQKQVGENSTTNTSKRSSRFRGVSRHRWTGRFEAHLWDKLSWNTTQKKKGKQGAYDEEESAARAYDLAALKYWGTSTFTNFPISDYDKEIEIMNTMTKEEYLATLRRKSSGFSRGVSKYRGVARHHHNGRWEARIGRVFGNKYLYLGTYSTQEEAARAYDIAAIEYRGIHAVTNFELSSYIKWLKPETTTEENHESQILQKESRTLAPPNNSTLLQESKLLALQKSFFIPNDLNSTEKQESSFENKNYHFLSNKSTSPTALSLLLRSSLFRELLEKNSNVSEDEVTKEQQQQQITSDDELGGIFYDGIDNISFDFDPNSCNIELQERDLHSISCLYQYLNFGQ

SEQ ID NO: 306 - protein, 386 aa, Populus trichocarpa
MMMIKNEENPGRRRGCIADSEAQVARCVKRRRRDPAIVALGSDDNQSQQQMPQKQTDQTSAATTVKRSSRFRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWIKPGVAAQAAANELQTVTDPQTAATLTDTYTPREETKPSLFLPNQFTADYLNSPPKLDAFQNNIFVDSSNKTSSPTALSLLLRSSVFRELVEKNSNVCEEETDGNEIKNQPMAGSDDEYGGIFYDGIGDIPFVYSSNKYSLGLEERELQFVL

SEQ ID NO: 307 - protein, 372 aa, Ricinus communis
MEMMMVKNEEISGRRRASVTESEAYVARCVKRRRRDAAVVTVGGDDSQSHQQQQQQQPEQQAHQISAATTVKRSSRYRGVSRHRWTGRFEAHLWDKLSWNVTQKKKGKQGAYDEEESAARAYDLAALKYWGTSTFTNFPISDYEKEIEIMQTVTKEEYLASLRRKSSGFSRGVSKYRGVARHHHNGRWEARIGRVFGNKYLYLGTYSTQEEAARAYDIAAIEYRGINAVTNFDLSTYIRWLKPEVAAQVAANEPQTVAESRMLPSINNRIAREESKPSFFSATPFSLDCWSYPRKQEEFQNRTPITPCSKTSSPTALSLLLRSSIFRELVEKNSNVSEDENEGEETKNQSQIGSDDEFGGLFYERIGDIPFI

SEQ ID NO: 308 - protein, 404 aa, Vitis vinifera
MEMMRVKSEENLGRRRMCVADAEAQGTRCVKRRRRDPAIVTLGCDDQSQQQQLPNQQPDQASAATTVKRSSRFRGVSRHRWTGRFEAHLWDKFSWNVTQKKKGKQGAYDEEESAARAYDLAALKYWGASTFTNFPVSDYEKEIEIMQSVTKEEYLACLRRKSSGFSRGVSKYRGVARHHHNGRWEARIGRVFGNKYLYLGTYSTQEEAARAYDIAAIEYRGINAVTNFDLSTYIRWLNPAANNPVVPHESRANTEPQALASSNFVLSEESEPLFFHSNSFTMDDLNPPHKQEVFQTKIPIEPCSKSSSPTALGLLLRSSIFRELVEKNSNAPEDETDAEDTKNQQQVGSDDEYGIFYDGIGDIPFVCPSNGDRNELQERLPLPFTISQGNPYGTAVLTSMQSIN

SEQ ID NO: 309 - protein, 378 aa, Brachypodium distachyon
MAKQRTDSAGTDAAAVQLTKPKRTRKSVPRRESPSRRTSAYRGVTRHRWTGRFEAHLWDKNTWTQSQRKKKGRQVYLGAYGGEEAAARAYDLAALKYWGRDTVLNFPLSNYDEEWKEMEGQSREEYIGSLRRKSTGFSRGVSKYRGVARHHHNGKWEARIGRVYGNKYLYLGTYGTQEEAAMAYDIAAIEHRGLNAVTNFDVSRYIDWHRRLCRDLGDNIITPLTNPTVDLEEAMAGDDDDGQFLLPSQATTPPSTSSALGLLLLSPRLKEVIEGSGAASAMAASTSESSAAGSPPPSWSSSSCSPSPPSPSHSPPETQQKQQQQEYGASAAAARCSFPDDVQTYFGCEDGCAEVDTFLFGDLSAYAAPMFQFELLDV

SEQ ID NO: 310 - protein, 416 aa, Oryza sativa
MAKRRSNGETAAASSDDSSSGVCGGGGGGEVEPRRRQKRPRRSAPRDCPSQRSSAFRGVTRHRWTGRFEAHLWDKNTWNESQSKKGRQGAYDGEEAAARAYDLAALKYWGHDTVLNFPLSTYDEELKEMEGQSREEYIGSLRRKSSGFSRGVSKYRGVARHHHNGKWEARIGRVFGNKYLYLGTYATQEEAAVAYDIAAIEHRGLNAVTNFDINLYIRWYHGSCRSSSAAAATTIEDDDFAEAIAAALQGVDEQPSSSPATTRQLQTADDDDDDLVAQLPPQLRPLARAASTSPIGLLLRSPKFKEIIEQAAAAAASSSGSSSSSSTDSPSSSSSSSLSPSPLPSPPPQQQPTVPKDDQYNVDMSSVAAARCSFPDDVQTYFGLDDDGFGYPEVDTFLFGDLGAYAAPMFQFELDV

SEQ ID NO: 311 - protein, 440 aa, Sorghum bicolor
MARPRKNAGTDEDNPNAATGVSVTGKPPKLKRVRRKGEPRESSTPSQRSSAYRGVTRHRWTGRFEAHLWDKDARNGSRNKKGKQGAYDDEEAAARAHDLAALKYWGPATVLNFPLCGYDEELREMEAQPREEYIGSLRRRSSGFSRGVSKYRGVARHHHNGRWEARIGRVLGNKYLYLGTFATQEEAAVAYDIAAIEHRGLNAVTNFDISHYVNHWHRHCHGPSDDSLGVVVDDVAAFQLPDDLPECPAAAIGVEETTGGDAEFHNGEEGYLQHHTSGPFGAQQQLPDETGALAAHQMAPNSSALDMVLQSPKFKELMEQVSAAAAAVASESSIGGSMSSSSPSPSLSSFSPSPLQLPSPSSLSSFSPSSPLQQPSPPLQQPEFVEGAPAARCSFPDDVQTFFDFENESDMSFMYAEVDTFLFGDLGAYAAPIFHFDLDV

SEQ ID NO: 312 - protein, 408 aa, Zea mays
MARPRKNGGTDEDDANAATGATGKPKKLMKRARRKSESPSPRSSAYRGVTRHRWTGRFEAHLWDKDARNGSRSKKGKQVYLGAYDDEDAAARAHDLAALKYWGPAGTVLNFPLSGYDEERREMEGQPREEYVASLRRRSSGFARGVSKYRGVARHHHNGRWEARIGRVLGNKYLYLGTYATQEEAAVAYDMAAIEHRGFNAVTNFDISHYINHWHRHCHGPCDGSLGAMDVAPNVSLELDLLECPATVGLGLEETTGDDEFHNREDYLGHLFGVQQLPDEMGPPAHQMAPASSALDLVLQSPRFKELMQQVSAAGASETNGGSMRSSPSTSLCSFSPSPLELPSPPLQQPTEFIDGAPPRCSFPDDVQSFFDFKNDNDMSFVYAEVDTFLFGDLGAYAPPMFDFDLYE

SEQ ID NO: 313 - protein, 304 aa, Arabidopsis lyrata
MAKVSRRSKKTIVEDEISDKTASASEAASIVFKSKRKRKSPPRNAPPQRSSPYRGVTRHRWTGRYEAHLWDKNSWNETQTKKGRQVYIGAYDEEEAAARAYDLAALKYWGRDTLLNFPLLIYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPDAADSKPIRNDPESSDDNKCPKSEEIIEPSTSPEAITTRRSFPDDIQTYFGCQDSGKLATEEDVIFGGLNSFINPGFYNEFDYGP

SEQ ID NO: 314 - protein, 308 aa, Arabidopsis thaliana
MAKVSGRSKKTIVDDEISDKTASASESASIALTSKRKRKSPPRNAPLQRSSPYRGVTRWTGRYEAHLWDKNSWNDTQTKKGRQGAYDEEEAAARAYDLAALKYWGRDTLLNFPLPSYDEDVKEMEGQSKEEYIGSLRRKSSGFSRGVSKYRGVARHHHNGRWEARIGRVFGNKYLYLGTYATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 315 - protein, 303 aa, Arabidopsis thaliana
MAKVSGRSKKTIVDDEISDKTASASESASIALTSKRKRKSPPRNAPLQRSSPYRGVTRHRWTGRYEAHLWDKNSWNDTQTKKGRQVYLGAYDEEEAAARAYDLAALKYWGRDTLLNFPLPSYDEDVKEMEGQSKEEYIGSLRRKSSGFSRGVSKYRGVARHHHNGRWEARIGRVFATQEEAAIAYDIAAIEYRGLNAVTNFDVSRYLNPNAAADKADSDSKPIRSPSREPESSDDNKSPKSEEVIEPSTSPEVIPTRRSFPDDIQTYFGCQDSGKLATEEDVIFDCFNSYINPGFYNEFDYGP

SEQ ID NO: 316 - protein, 332 aa, Arabidopsis lyrata
MEEITRKSKKTSVENETGDDQSATSVVVKAKRKRRSQPRDAPPQRSSVHRGVTRHRWTGRYEAHLWDKNSWNETQSKKGRQGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYMKLPVPENPIDAANNLLESPHSDSSPFINPTHESDLSQSQSSSDDNDDRKTKLLKSSPLNAEEVIGPSTPPEIAPPRRSFPEDIQTYFGCQNSGKLTTEEDDVIFGDLDSFLTPDFYSELNDC

SEQ ID NO: 317 - protein, 328 aa, Thellungiella halophila
MAKVSQRSKKTIVNDEISDKKAVAVASVSSSAFLKSKRKRKLPPQNAPPQRSSSYRGVTRHRWTGRYEAHLWDKNCWNETQTKKGRQVYLGAYDEEEAAARAYDLAALKYWGRDTLLNFPLPTYEEDVKEMEGHSREEYIGSLRRKSSGFSRGVSKYRGVARHHHNGRWEARIGRVFGNKYLYLGTYATQEEAARAYDIAAIEYRGLNAVTNFDVSRYLNLPESKNPSAAANHLPDESDYYDSMPVRNPNHEPRSPDGQTSSEDNDYTKTEETLDPEAIPSRRSFPDDIQTYFGCQDSGKLATEEDVIFGGFNSFINPGFYNDFDYAP

SEQ ID NO: 318 - protein, 345 aa, Arabidopsis thaliana
MFIAVEVSPVMEDITRQSKKTSVENETGDDQSATSVVLKAKRKRRSQPRDAPPQRSSVHRGVTRHRWTGRYEAHLWDKNSWNETQTKKGRQVYLGAYDEEDAAARAYDLAALKYWGRDTILNFPLCNYEEDIKEMESQSKEEYIGSLRRKSSGFSRGVSKYRGVAKHHHNGRWEARIGRVFGNKYLYLGTYATQEEAAIAYDIAAIEYRGLNAVTNFDISRYLKLPVPENPIDTANNLLESPHSDLSPFIKPNHESDLSQSQSSSEDNDDRKTKLLKSSPLVAEEVIGPSTPPEIAPPRRSFPEDIQTYFGCQNSGKLTAEEDDVIFGDLDSFLTPDFYSELNDC

SEQ ID NO: 319 - protein, 299 aa, Glycine max
MAKKSQKSLKNNNNNNTTRKRTRKSVPRDSPPQRSSIYRGVTRHRWTGRYEAHLWDKNCWNESQSKKGRQVYLGAYDDEEAAARAYDLAALKYWGQDTILNFPLSNYEEKLKEMEGQSKEEYIGSLRRKSSGFSRGVSKYRGVARHHHNGRWEARIGRVFGNKYLYLGTYATQEEAAAAYDMAAIEYRGLNAVTNFDLSRYINWPRPKTEENHQNTPSNQNVNSNAELELGSASDEITEEGVARSSESESNPSRRTFPEDIQTIFENNQDSGIYIENDDIIFGDLGSFGAPIFHFELDV

SEQ ID NO: 320 - protein, 393 aa, Brachypodium distachyon
MAKPRKNSAAANNNNNDNSTNANNAVAEAAAADVRAKPKKRTRKSVPRESPSQRSSIYRGVTRHRWTGRFEAHLWDKNSWNESQNKKGKQVYLGAYDEEEAAARAYDLAALKYWGPDTILNFPLSVYDDELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGGGVDSAAAAAARNPHPMLAGLATQEELPAIDHLLDGMAFQQHGLHSSSAAAAAAQEFPLPPALGHAPTTSALSLLLQSPKFKEMIERTSAAETTTTATTTSSSSSPRPAASPQCSFPEDIQTFFGCDDGVGVGVGAVGYTDVDGLFFGDLSAYASSTAFHFELDL

SEQ ID NO: 321 - protein, 379 aa, Oryza sativa
MAKPRKNSTTTNTSSSGVAAAAAAAAVKPKRTRKSVPRESPSQRSSVYRGVTRHRWTGRFEAHLWDKNSWNESQNKKGKQVYLGAYDDEEAAARAYDLAALKYWGPDTILNFPLSAYEGELKEMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGADGAGAAQNPHPMLGALSAQDLPAIDLDAMASSFQHDGHGAAAAAAQLIPARHSLGHTPTTSALSLLLQSPKFKEMIERTSAAETTTTSSTTTSSSSPSPPQATKDDGASPQCSFPKDIQTYFGCAAEDGAAGAGYADVDGLFFGDLTAYASPAFHFELDL

SEQ ID NO: 322 - protein, 398 aa, Sorghum bicolor
MAKPRKNSAAANNNNSSSNGAGDLTPRAKPKRTRKSVPRESPTQRSSVYRGVTRHRWTGRFEAHLWDKNSWNESQNKKGKQVYLGAYDDEEAAARAYDLAALKYWGPDTILNFPASAYEGEMKGMEGQSREEYIGSLRRKSSGFSRGVSKYRGVARHHHNGRWEARIGRVFGNKYLYLGTYATQEEAAMAYDMAAIEYRGLNAVTNFDLSRYIKWLRPGAGGMAAAAAAAQNPHPMLGGLAQQLLLPPPADTTTTDGAGAAAFQHDHHGAEAFPLPPRTSLGHTPTTSALSLLLQSPKFKEMIQRTESGTTTTTTTTSSLSSSPPPTPSPSPPRRSPAPTQPPVQAAARDASPHQRGFPEDVQTFFGCEDTAGIDVEALFFGDLAAYATPAFHFEMDL

SEQ ID NO: 323 - protein, 396 aa, Zea mays
MARPRKNSAAAANNNNSNTTNAGNAAVDLAARVKPKRTRKSVPRESPSQRSSVYRGVTRHRWTGRFEAHLWDKNSWNESQNKKGKQVYLGAYDDEDAAARAYDLAALKYWGPDTILNFPASAYEAELKEMEGQSREEYIGSLRRKSSGFSRGVSKYRGVARHHHNGRWEARIGRVFGNKYLYLGTYGTQEEAAMAYDMAAIEYRGLNAVTNFDLSRYIKWLRPGAGAAQNPHPMLDGLAQQLLLSPEGTIDGAAFHQQQHDHRQQGAAELPLPPRASLGHTPTTSALGLLLQSSKFKEMIQRASAAESGTTTVTTTSSSSSQPPTPTPTPSPSPPPTPPVQPARDASPQCSFPEDIQTFFGCEDVAGVGAGVDVDALFFGDLAAYASPAFHFEMDL

SEQ ID NO: 324 - protein, 362 aa, Glycine max
MAKKSQLRTQKNNATNDDINLNATNTVITKVKRTRRSVPRDSPPQRSSIYRGVTRHRWTGRYEAHLWDKHCWNESQNKKGRQGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNTNSNNDQISINLTNINNNCTNNFIPNPDQEQEVSFFHNQDSLNNTIVEEATLVPHQPRPASATLALELLLQSSKFKEMVEMTSVANLSTQMESDQLPQCTFPDHIQTYFEYEDSNKYEEGDDLLFKFSEFSSIVPFYHCDEFES

SEQ ID NO: 325 - protein, 370 aa, Glycine max
MAKKSQLRTQKNNVTTNDDNNLNVTNTVTTKVKRTRRSVPRDSPPQRSSIYRGVTRHRWTGRYEAHLWDKHCWNESQNKKGRQVYLGAYDNEEAAAHAYDLAALKYWGQDTILNFPLSNYLNELKEMEGQSREEYIGSLRRKSSGFSRGISKYRGVARHHHNGRWEARIGKVFGNKYLYLGTYATQEEAATAYDLAAIEYRGLNAVTNFDLSRYIKWLKPNNNTNNVIDDQISINLTNINNNNNCTNSFTPSPDQEQEASFFHNKDSLNNTIVEEVTLVPHQPRPASATSALELLLQSSKFKEMMEMTSVANLSSTQMESELPQCTFPDHIQTYFEYEDSNRYEEGDDLMFKFNEFSSIVPFYQCDEFES

SEQ ID NO: 326 - protein, 356 aa, Medicago truncatula
MAKKSQKQIEKDDNASNDNDNLNPSNTVTTKAKRTRKSVPRTSPPQRSSIYRGVTRHRWTGRYEAHLWDKNCWNESQNKKGRQGAYDNEETAAHAYDLAALKYWGQDTIINFPLSNYQKELIEMESQSREEYIGSLRRKSSGFSRGVSKYRGVARHHHNGRWEARIGKVFGNKYLYLGTYATQEEAATAYDMAAIEYRGLNAVTNFDLSRYIKWLKPNNNNNDDNNKSNINLCDINSNSSANDSNSNEELEFSLVDNEISLNNSIDEATLVQPRPTSATSALELLLQSSKFKEMVEMASMTSNVSTTLESDQLSQCAFPDDIQTYFEYENFNDTMLEDLNSIMPTFHYDFEGAEVL

SEQ ID NO: 327 - protein, 347 aa, Glycine max
MAKQQTHKINASTNNNISTTNTVTAKVKRTRRSVPRDSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGVNAVTNFDLSRYIKWLKPNNNNTTVNSNLIDSNPNCETNFTSNSNQQQGFNFFNRQESFNNEEAAMTQPRPAVATSALGLLLQSSKFKEMMEMTSATDLSTPPSESELPSCTFPDDIQTYFECEDSHRYGEGDDIMFSVLNGFVPPMFHCDDF

SEQ ID NO: 328 - protein, 351 aa, Glycine max
MAKQQTHEINASTNNNINTTKTVTTKVKRTRRSVPRNSPPQRSSIYRGVTRHRWTGRYEAHLWDKNCWNESQNKKGRQGAYDDEEAAAHAYDLAALKYWGQDTILNFPLSTYQNELKEMEGQSREEYIGSLRRKSSGFSRGVSKYRGVARHHHNGRWEARIGRVFGNKYLYLGTYATQEEAATAYDMAAIEYRGLNAVTNFDLSRYIKWLKPNNNNNKVNSNNLIVSIPNCATNFTPNSNQQQGFNFFNSQESFNNNEEAAMTQPRPAAATSALGLLLQSSKFKEMMEMTSAIDLSTPPSESELPPCTFPDDIQTYFECEDSHRYGEGDDIMFSELNGFVPPMFHCDDFEA

SEQ ID NO: 329 - protein, 353 aa, Populus trichocarpa
MAKLSQKNTKNTASNNNNTTNGVTKVKRTRRSVPRDSPPQRSSIYRGVTRHRWTGRYEAHLWDKNCWNESQNKKGRQGAYDDEEAAAHAYDLAALKYWGPETILNFPLSTYQNELKEMEGQSREECIGSLRRKSSGFSRGVSKYRGVARHHHNGRWEARIGRVFGNKYLYLGTYATQEEAATAYDMAAIEYRGLNAVTNFDLSRYIKWLKPNQNNTDNNNGLDLPNPIIGTDNSTHPNPNQELGTTFLQINQQTYQPSETTLTQPRPATNPSSALGLLLQSSKFKEMMEMTAVTDCPPTPPSGLDPTPCSFLEDVQTYFDCLDSSNYGDQGDDMIFGDLNSFVPPMFQCDFET

SEQ ID NO: 330 - protein, 323 aa, Vitis vinifera
MAKLSQQNHKNSANSNATNTTLSVTKVKRTRKTVPRDSPPQRSSIYRGVTRHRWTGRYEAHLWDKNCWNESQNKKGRQVYLGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACKMMEMTTAADHLSTPPESELPRCSFPDDIQTYFECQDSGSYEEGDDVIFSELNSFIPPMFQCDFSA

SEQ ID NO: 331 - protein, 347 aa, Vitis vinifera
MAKLSQQNHKNSANSNATNTTLSVTKVKRTRKTVPRDSPPQRSSIYRGVTRHRWTGRYEAHLWDKNCWNESQNKKGRQGAYHDEEAAAHAYDLAALKYWGPETILNFPLSTYEKELKEMEGLSREEYIGSLRRRSSGFSRGVSKYRGVARHHHNGRWEARIGRVFGNKYLYLGTYATQEEAATAYDMAAIEYRGLNAVTNFDLSRYIKWLKPNQNNPCEQPNNPNLDSNLTPNPNHDFGISFLNHPQTSGTAACSEPPLTQTRPPIASSALGLLLQSSKFKEMMEMTTAADHLSTPPESELPRCSFPDDIQTYFECQDSGSYEEGDDVIFSELNSFIPPMFQCDFSA

SEQ ID NO: 332 - protein, 275 aa, Populus trichocarpa
MGKTSKQSLKNSANTSINPATKVKRTRKSVPRDSPPQRSSIYRGVTRHRWTGRYEAHLWDKNCWNESQNKKGRQGAYDDEEAAGHAYDLAALKYWGQDTILNFPLSTYEEEFKEMEGHSKEEYIGSLRRKSSGFSRGVSKYRGVARHHHNGRWEARIGRVFGNKYLYLGTYATQEEAATAYDMAAIEYRGLNAVTNFDLSRYSSKFKEMLERTSASDCPLTPPESDRDPPRRSFPDDIQTYFDCQDSSSYTDGDDIIFGDLHSFASPIFHCELDG

SEQ ID NO: 333 - protein, 304 aa, Vitis vinifera
MAKTSQKSQKTTGNSTNNNGGSVAKVKRTRKSVPRDSPPQRSSIFRGVTRHRWTGRYEAHLWDKNCWNESQNKKGRQVYLGAYDDEEAAAHAYDLAALKYWGQETILNFPLSAYQEELKEMEGQSKEEYIGSLRRKSSGFSRGVSKYRGVARHHHNGRWEARIGRVFGNKYLYLGTYATQEEAATAYDMAAIEYRGLNAVTNFDLSRYINSPAPNPNPSDHELGLSFLQQQHGSDATELPLSHARSDCPLTPPDQIEMPRSSFPDDIQTYFDCQETNSYGESDDIIFGDLKYFSSPMFQCELDT

SEQ ID NO: 334 - protein, 393 aa, Sorghum bicolor
MASPNPEAAAGLQTVAVAAGGGEGGSSSSLGAVAGAAAVSSSGELVPRRSLAVRKERVCTAKERISRMPPCAAGKRSSIYRGVTRHRWTGRYEAHLWDKSTWNQNQNKKGKQGAYDDEEAAARAYDLAALKYWGAGTQINFPVSDYARDLEEMQMISKEDYLVSLRRQLHNSRWDTSLGLGNDYMSLSCGKDIMLDGKFAGSFGLERKIDLTNYIRWWLPKKTRQSDTSKTEEIADEIRAIESSMQQTEPYKLPSLGLGSPSKPSSVGLSACSILSQSDAFKSFLEKSTKLSEECTLSKEIVEGKTVASVPATGYDTGAININMNELLVQRSTYSMAPVMPTPMKTTWSPADPSVDPLFWSNFVLPSSQPVTMATITTTTNEVSSSDPFQSQE

SEQ ID NO: 335 - protein, 428 aa, Lupinus angustifolius
MASSSSDPGKSEIGGGAAETSEAAAVAVAVTNDQSLLYRGLKKAKKERGCTAKERISKMPPCAAGKRSSIYRGVTRHRWTGRYEAHLRDKSTWNQNQNKKGKQVYLGAYDDEEAAARAYDLAALKYWGPGTLINFPVTDYTRDLEEMQNVSREEYLASLRRKSSGFSRGISKYRALSSRWEPSYSRFAGSDYFNSMHYGAGDDSAAESEYASGFCIERKIDLTGHIKWWGSNKSRQPDAGTRLSEEKRHGFAGDICSEPKTLEQKVQPTEPYQMPELGRSHNEKKHRSSAVSALSILSQSAAYKSLQEKASKKQENSTDNDENENKNTVNKLDHGKAVEKSSNHDGGSDRVDIEIGTTGALSLQRNIYPLTPFLSAPLLTAYNTVDPSLVDPVLWTSLVPMLSAGLSCPTQVTKTETSSSYTIFQPEG

SEQ ID NO: 336 - protein, 440 aa, Ricinus communis
MASSSSDPGLKPELGGGSGGESSEAVIANDQLLLYRQLKKPKKERGCTAKERISKMPPCTAGKRSSIYRGVTRHRWTGRYEAHLWDKSTWNQNQNKKGKQGAYDDEEAAARAYDLAALKYWGPGTLINFPVTDYSRDLEEMQNVSREEYLASLRRKSSGFSRGISKYRGLSSQWDSSFGRMPGSEYFSSINYGAADDPAAESEYVGSLCFERKIDLTSYIRWWGFNKTRESVSKSSDERKHGYGEDISELKSSEWAVQSTEPYQMPRLGMPDNGKKHKCSKISALSILSHSAAYKNLQEKASKKQENCTDNDEKENKKTNKMDYGKAVEKSTSHDGSNERLGAALGMSGGLSLQRNAYQLAPFLSAPLLTNYNAIDPLVDPILWTSLVPVLPAGFSRNSEVGMGLQIVSCHKDRDKFNLYLLSAGGVSTFLLLVVHWRFC

SEQ ID NO: 337 - protein, 428 aa, Lupinus angustifolius; identical to SEQ ID NO: 335

SEQ ID NO: 338 - DNA, 1527 bp, Aspergillus fumigatus
atgaagatgagtgcttccaaaacagtaacttcgtcagccagtgccgttagcacgagctctggaaggtcgactccgtcgaagctcgtcaatggagctacccgcaatggctccgcagcagctggcaacggctctaccgggacagccaaagggaagaggaggagcaaatatcgccatgttgcagcttatcattcagagctgcggcattcgagcctcagtagagagaccagtgtggtcccaagctttcttggattccggaatctcatggtgattgttttagtggcgatgaatcttcgcctgataattgaaaatttcatgaaatatggcgtccttatctgcatcaaatgtcatgactatcggaagcaggatgtagttcttgggtcgattctctttgcccttgttccatgccatctcttccttgcgtacatcattgaattggttgcagctcagcaatccaagaaaactgtcggtcgacagaaaaaggatctatcgacggaggagagggagcgcgaacaacaggccttccgctcaacctggaggtatacagccttcttccataccgtgaacgctaccctttgcctcgccgtgaccagcttcgttgtttatttctacatcaatcatcctggaatcggtacaatttgtgagctccacgcaatcattgtgtggctcaaaaattgctcctatgcatttacgaatcgcgatctgcggcaggcaatggtcgacccctctgcagagtctgctctcccagaaatctactccacatgcccatatccaagaaatatcacacttgggaaccttacatatttttggctagcaccgacacttgtatatcaacccgtttatcctcgatcgtcgcatattcgatggtcttttgttgccaaacggcttgctgagttttttggtttagctgtcttcatatggcttctctcggctcagtatgcagccccggtcttgcgaaattccattgacaagatagctgtgatggatattgcgtcaatcctcgagcgggtcatgaaactctccacaatttcgcttgtcatttggctcgctggattctttgcgctcttccagtcgctgctgaatgctttggcggaggtcatgcggttcggagatcgtgagttctacacagattggtggaacagcccgagtctcggcgcatactggcggtcatggaacaggccggtgtacctcttcatgaagaggcatgttttctcgccgctggtaggaagaggctggagcccttttgcggcgagcttcatggtcttttccctctctgcagtcctgcatgagatgttggtggggattcctacccacaatttgatcggtgttgcatttgcggggatgatgttccagctgccattgattgctgtgacagctccctttgaaaaggtgaatgacgccttgggcaagattgtagggaactcaatcttctgggtaagcttttgcctcgttggtcaaccgctgggtgcgctcttgtatttctttgcatggcaggcgaagtacggaagtgtcagcaagatacacgtttag

SEQ ID NO: 339 - DNA, 2067 bp, Ricinus communis
ggacactgacatggactgaaggagtagaaacttcttcttctgctgctgttcctctctcctccaccgccacgctcacctctctttgcatgacataatactattgttcttattatcattttcactctttaaatacaaacatcaattattccttttctatcaaacacatgtattctattctctcgtcgtctagattctcatcttcattgaatcctccttcttagcgtgtctttgtccacttcttttgggcaccgacgtttttaatctccatgacgattctcgaaacgccagaaactcttggcgtcatctcctcctccgccacttccgatctcaacctctctctccgacgtagacggacctcaaatgactccgatggtgcacttgctgatttggcttcgaagtttgatgatgatgacgacgtaagatcggaagattctgctgaaaatattatcgaagatcctgtagcagcggttactgaattggcgacagcaaagagtaacggaaaagactgtgttgccaatagtaataaggataaaattgatagccatggaggatcatcggattttaaacttgcatataggccttcggttccagctcaccggtcacttaaggagagtccgcttagctctgatttaatatttaaacaaagtcatgcaggtctgtttaacctttgtatagtagtgctcgtagctgttaacagcaggctcatcattgagaatttaatgaagtatggctggttaattaagacgggcttttggtttagttcaagatcattgagagattggccgctttttatgtgctgtctttctctcccagtattcccccttgctgcctatctagttgagaaggccgcatatcgaaaatatatatctccgcctattgttattttccttcatgtgatcatcacctcagcagctgttttgtacccagcttctgtaattctcagttgtgaatctgcttttttatctggtgtcacattgatggaacttgcttgtatggtatggttgaaattggtatcctatgcacatacaaactatgatatgagagcgatcgctgacaccattcataaggaagatgcatccaattcttctagtacagagtattgtcatgatgtgagctttaagactttggcgtacttcatggtcgcacccacattatgttaccagccaagttatcctcgcacagcatttattagaaagggctgggtgttccgtcaatttgtcaaactaataatttttacaggattcatgggatttatcatagaacaatacatcaatcctatcgtccagaattctcaacaccctttaaaaggggatctcttatatgccattgagagggttctgaagctctcagttccgaatttatatgtgtggctctgcttgttctactgcttttttcacctgtggttgaatatagttgctgagctccttcgcttcggtgaccgggagttctacaaagattggtggaatgcaaaaactgttgaggagtactggaggatgtggaatatgcctgttcacaagtggatggttcgccatatctacttcccatgcctacgtcgtaaaataccaaggggggtagcaatagttattgctttcttcgtttcagctgtatttcatgagttgtgcattgctgttccttgccacatgttcaaactttgggctttttttggaataatgtttcagattcctttagttgtgatcactaattattttcaaaggaagttcagaagctcaatggtgggaaatatgatcttctggttctttttctgcattctcggccaacctatgtgtgtactgttgtattaccatgacctaatgaatcgcgatgggaactgaaccatgggctcagtccagatatgggtacaccttccaagatgttattttcgtgagtgaagactgcaccacagtgttgttcttgttacacaatccccattgacagagtaggttaatcgtcagtttcaggagataagacacaattttgaaagtacagcagaggctgctattaatgtatcatgttgagtttctgttatgttatgttattcttttttaatctcaaaaaaaaaaaaaaaaa

SEQ ID NO: 340 - DNA, 2084 bp, Vernicia fordii
tctctctctctttgctttacgtgtacatcgaccaccaccacagccatcttgcgactgttcaattatcctataagtaccaccgcattcatcaccgccaatccttaactctaatttgctatactaaacacttgctttatatgcgcttttctatttactcttcactgtaatttcttattggtattcaaagtgttttcaatgacaatccctgaaacgccggataattccacggatgctaccaccagtggcggtgctgagtcctcttccgatcttaacctttctcttcgacggaggaggactgcttcaaactccgatggagctgtcgcggaattggcttccaagattgatgagttggaatctgatgccggaggaggccaggtgattaaggatccgggagcagaaatggattcggggactttgaaaagtaatggaaaagattgcggaaccgttaaggataggattgaaaatcgtgagaatcgtggaggatcggatgttaaattcacgtatcggccgtcggtgccggctcaccgggcgctcaaggagagtccgcttagctctgataatatatttaaacaaagtcatgcaggtctcttcaatctctgtatagtagtgcttgtagcggttaacagtcggcttatcattgaaaacataatgaagtatggttggttaattaagactgggttttggtttagttcaagatcgttgagagactggccacttcttatgtgctgtcttaccctcccaatattttctcttgctgcctatctagttgagaagttggcctgtcggaagtatatatctgcacccactgttgtttttcttcatattcttttctcctcaacagcagttttataccctgtttctgtgattctcagttgtgaatctgctgttttgtccggtgtcgcattgatgctctttgcttgtatcgtgtggttgaaattggtatcttatgcacatacaaactttgatatgagagcaattgctaactcagttgataagggagatgcgctatccaatgcttcgagtgcagagtcctctcatgatgttagcttcaagagtttggtttatttcatggttgctcccacattgtgttaccagccaagttatcctcgaactgcatccattcgaaagggttgggtggttcgtcaatttgttaagttaataatatttacaggattcatgggatttatcatagaacaatatatcaatcctatcgttcagaattcacaacatcctttaaaaggggatctcttatatgccattgagagggttttgaagctctcagttccgaatttatatgtctggctttgcatgttctactgcttttttcacctatggttaaatatacttgctgagctccttcgctttggtgatagagagttctataaagattggtggaatgcaaggacagttgaggagtattggagaatgtggaatatgcctgttcataagtggatggttcgccatatctactttccatgcttgcggcataaaataccaaggggggtggccttattaattactttcttcgtttcagcagtatttcatgagttgtgcattgctgttccttgccacatattcaagctctgggcttttattggaataatgtttcagattcctttggtcgggatcacaaattaccttcaaaacaagttcagaagctcaatggtggggaacatgatcttctggttcattttctgcattcttggtcaaccaatgtgcttgctgttgtattaccatgacctaatgaatcgaaaagggactaccgaatcaagatgacactaactcatcgtgtggtagactctatatatatacatagacttaccagagatgggttgcttccaacatattgtgcacaagaggcaattgttgttctcatcagaagagtgggttaattaattaattaatgtacaagcaattttgaaagtataatcactggcagggactagtgcccgactgtagtactgagattatagaggtattatcaatcgttagtggaaaattgtaaatgtataaagttcaatctttgtattgtttcttttctaatatcatatttttttttattgctcatcaaaaaaaaaaaaaaa

SEQ ID NO: 341 - DNA, 1828 bp, Vernonia galamensis
tctgagctcaaatcaaatttctgcgactcatacaggattcaactcaatactttcttgatcggttctgctgttcatttacttgtaatttctacttctgctttgctttcatttcaagcttttttccttaataatggcgttattagatacgcctcagattggagaaataacgaccaccgccaccacaactataagacggcggaccactgtcaagcctgatgctggaatcggagatggattgtttgattcttcgtcgtcttccaaaaccaactcatccttcgaggatggtgacagtttgaatggtgatttcaatgacaaatttaaggaacagatcggagctggtgatgaatccaaggacgactccaaggggaacggacagaagatagatcacggaggagttaaaaagggacgtgaaacgactgtggtgcattatgcttatcggccttcttctccggctcatcggagaattaaagaatctccgcttagctctgacgccatcttcaagcagagtcatgcaggcctctttaacctttgcatagtggtgcttgttgcagtaaatggtaggctcatcattgagaatctgatgaagtatggactattgatcaattccaacttttggttcagttcgagatcattgagagactggccacttctgatgtgctgcctcactccttctgactttccacttgctgcctacattgttgagaaattggcatggaaaaaacgtatatccgaccctgttgtaatcacactccatgttataataactacaactgcaattctttatccggtcttcatgattctgaggttcgattcagttgttctatcaggcgtctcgttgatgctgtgtgcttgcattaattggttgaagttggtatcttttgtgcatacaaattatgacatgcggtcgcttttgaactcaactgataagggagaagtggaacccatgtcttcaaatatggattatttttatgatgtcaacttcaaaagcttggtttatttcatggttgctccaactttgtgttaccagataagctatcctcgcactgcatttattcgaaagggttgggtgttacggcaactgatcaagctagtaatatttacagggttcatgggattcatcattgaacaatatatcaatccgattgtcaaaaattctcgtcatccattgaaaggagactttttatatgcgattgagcgggttttaaagctttcagttccgaatttatatgtgtggctctgtatgttctactgcttttttcacctttggttaaatatacttgctgagcttctttgttttggggatcgtgaattttataaagattggtggaatgcacaaactattgaagagtattggaggctatggaatatgcctgttcataaatggattgttaggcacctttattttccatgcttgcgtaatgggatacctaagggtgctgccatattggttgcatttttcatgtctgccgtgttccatgagctttgtattgctgttccctgccacattttcaagttttgggcttttatcgggatcatgtttcaggtcccgttggtcctactcacaaattacttgcagcacaagtttcaaaactcgatggtgggaaatatgatcttctggtgctttttcagcatttttggtcaacccatgtgtgtattactttactaccatgatgtcatgaatcaaaaggggaaaagcaaataaaaagatgtgattgtgttgctccatttgatctcatagcatgactggactaaacaaacccaagggacacattttagtccttaaaggaaaatttttgtaggaaaaaaaaaaaaaaaaaaaaaaaaaaaa

SEQ ID NO: 342 - DNA, 1738 bp, Vernonia galamensis
gttcgtaattcggctgtggtttcctttccaacatttctacgtaatcatggcgttgttagatacgcctcaaattggagaaataacgacgaccgcaacaacgaccattaggcagcaccccctgggcaagcctgatgctggaattggagatggattgttttcttcgtcgtcttccaaaaccaactcatccttcgaggatggtgacagtttgaatggtgatttcaatgacaaatttaaggaacagatcggagctggtgatgaatccaagaaggggaacggaaagatagatcacggaggagttaaaaagggacgtgaaacgactgtggtgcattatgcttatcggccttcttctccggctcatcggagaattaaagaatctccgcttagctctgacgccatcttcaagcagagtcatgcaggcctctttaacctttgcatagtggtgcttgttgcagtaaatggtaggctcatcatcgagaatctgatgaagtatggactattgattaattccaaattttggttcagttcgagatcattgagagactggccgcttctgatgtgttggctgaccccctccgacttccccctcgccgcctacattgtcgagaaattggcatggaaaaaacgtatatccgaccctgttgtaatcacactccatgttgtaataactacaactgcaattctctatccgatcttcatgattctgaggttcgactcggtcgttctattaggcgtctcgttgatgctgtgtgcttgcattaattggttgaagttggtatcttttgtgcatacaaattatgacatgcggtcgctattgaactcaactggtaagggagaagtggagcccatgtcttcaaatatggactacttttatgatatcaacttcaaaagcttggtttatttcatggttgctccaactttgtgttaccagataagctatcctcgcaccgcctttattcgaaagggctgggtgttccggcaactgatcaagctagtaatatttacagggttcatgggattcatcattgaacaatatatcaatccgattgtcaaaaattctcggcatccattgaacggagactttttatatgcgattgaacgagtattaaaggtttcagttccgaatttatatgtgtggctctgtatgttctattgcttttttcacctttggttaaatatacttgctgagcttctttggtttggggatcgtgaattttataaagattggtggaatacacaaactattgaagagtattggaggctatggaatatgcctgttcataagtggattgttaggcacctctattttccatgcttgcgtaatgggatatctaagggtgctgccatattggttgcttttttcatgtctgccgtgttccacgagctttgcatagctgttccctgccacattttaaagttttgggctttcatcgggatcatgttccaggtcccgttggtactactcacaaattacttgcagcacaagtttcaaaactcgatggtgggaaacatgatcttttggtgcttcttcagcattttcggtcaacccatgtgtgtatttctttactaccatgaagtcaatcaaaaggggaaaagcaaatgaaaggacgttatcgtatttccccaatctttcttatatcgtgaatctaatatccataacaaagcaaaacaattaagtcactggagaatactattagcaggtaataaagaaccaaacaaaaaaaaaaaaaaaaaaaaaaaa

SEQ ID NO: 343 - DNA, 1524 bp, Euonymus alatus
atggctgctaacttgaacgaagcctcggatcttaatttttcgcttcggaggagaactggtggcatctcaagtacgactgtgcctgattctagttccgagacaagttcgtcggaggcggactatttggacggaggcaaaggtgccgcggacgtcaaagatcgtggggatggtgcggtggagtttcagaattcgatgaagaacgtggagaggattgagaaacatgagagccgagtaggattggattcgagattcacgtataggccatcggtcccggctcatcgcacaataaaggagagcccgcttagctcggacgcaatattcaaacagagtcacgcaggtctcttcaatctctgtatagtagttctggttgctgtgaacagcaggctgatcattgaaaatctaatgaagtatggatggttaataaggagtgggttttggttcagctcaagatcattgagagactggcccctttttatgtgttgtctcacactaccagtattccctcttgctgcttttctgtttgagaagttggctcaaaaaaatttaatatctgaacctgttgttgttttgcttcatatagtaaacactacagctgccgttttataccctgttttggtgattctaaggtgtgattctgcctttatgtctggggttacgttgatgctctttgcttgtattgtgtggttaaagttggtatcttatgctcataccaactatgatatgagagccctcaccaagtctgttgaaaagggggacacgccgttgagctctcagaacatggattactcgtttgatgtcaatatcaagagtttggcatattttatggttgctcccacattatgttaccagattagctatcctcgtaccccatatgttcgcaagggttgggtggttcgtcaatttgtcaagttaataatatttactggacttatgggatttataattgaacaatatatcaatcctattgtccagaattcacaacaccctttgaaaggaaactttttgtatgccattgagagagttttgaagctttcagtcccaaacctttatgtttggctctgcatgttctactgcctttttcatctctggttaaacatacttgctgaacttctttgttttggtgatcgtgagttctacaaggattggtggaacgctaaaactgttgaggagtactggagaatgtggaacatgcctgttcataagtggatggttcgtcatatctacttcccatgcttgaggaacgggatacccaagggtgttgcttttgtcatttccttcttagtttctgccgtcttccatgagctatgcattgctgttccctgccacatcttcaagttatgggctttctttggaataatgcttcaggttcccttggtgttgatcacaagttatctgcaaaataagttcagaagctcaatggtgggaaatatgatgttttggttctctttctgcatttttggtcaacctatgtgcttacttctatattaccatgatttgatgaatcgcaatgggaagatggagtag

SEQ ID NO: 344 - DNA, 1497 bp, Caenorhabditis elegans
atgcaaatgcgtcaacaaacgggacgacggcggcgtcagccttcggaaacatctaatggttctttggcttccagtagacgctcctcatttgcacaaaatggtaattcgtcaaggaaaagttcagaaatgagagggccttgcgagaaagtggtacatactgctcaagattcattgttttcgacgagttctggatggacaaatttccgtggattcttcaatttgtctattttacttttggtactttcaaatggacgcgtggcacttgaaaatgtgatcaaatatggtattttgataacaccccttcagtggatctcaacgtttgttgagcatcactactcaatttggagctggccaaatcttgctctcatcctatgctcaaatattcagattctctcggtttttggaatggaaaaaattcttgaacgtggatggcttggaaacggattcgctgcagtgttctacacctcgcttgtgattgcacatctgacaattccagttgtggtcactcttacccacaaatggaagaatcctttgtggtcagtcgtaatgatgggtgtttatgttattgaagctctcaaattcatctcatatggccacgtcaactactgggctcgtgatgctcggcgaaaaatcacagagctcaaaacacaagtcaccgatttggcaaagaaaacatgtgatccgaaacaattttgggatttgaaagatgaattatcaatgcatcagatggctgctcaatatcctgccaatttgacactttccaatatctactacttcatggctgcaccaacattgtgctacgaattcaaatttccaagattgttgcgaattcggaagcactttttgattaaaagaaccgtggagcttatctttctatcgtttttgatagctgcacttgttcaacaatgggttgttccgactgtccgaaatagtatgaaacctttaagtgaaatggaatactctagatgtttggaacgactcttgaaacttgcaattccaaatcatctcatctggcttctattcttctacacattcttccattcatttttgaacttgatcgccgagctgcttcgatttgccgatcgtgagttctacagagacttttggaatgcagagacgataggatatttctggaaatcatggaacatcccagttcaccgatttgctgttcgccacatctacagtccaatgatgcgtaacaatttctcaaaaatgagcgcattcttcgttgtgttcttcgtgtcggcattcttccatgaatatctggtttctgtgccattaaagattttccgattgtggtcctactatggaatgatgggacaaattcctctatccattatcactgataaagtggtgagaggtggacgtacaggaaacatcatcgtctggctctcactgattgttggccaacctcttgcaattctcatgtacggacatgattggtacattttgaactttggtgtttcagcagttcaaaaccaaaccgttggtatttga

SEQ ID NO: 345 - DNA, 1751 bp, Rattus norvegicus
gaagattgggccgcgacgaggtgcgggccgaagccatgggcgaccgcggaggcgcgggaagctctcggcgtcgcaggaccggctcgcgggtttccgtccagggaggtagtgggcccaaggtagaagaggacgaggtgcgagaagcggctgtgagccccgacttgggcgccgggggtgacgcgccggctccggctccggctccagcccatacccgggacaaagaccggcagaccagcgtgggcgacggccactgggagctgaggtgccatcgtctgcaagactctttgttcagctcagacagcggtttcagcaattaccgtggtatcctgaattggtgcgtggtgatgctgatcctgagtaatgcaaggttatctttagagaatcttatcaagtatggcatcctggtggatcccatccaggtggtgtctctgtttctgaaggacccctacagctggcctgccccatgcttgatcattgcatccaatatctttattgtggctacatttcagattgagaagcgcctgtcagtgggtgccctgacagagcagatggggctgctgctacatgtggttaacctggccacaattatctgcttcccagcagctgtggccttactggttgagtctatcactccagtgggttccctgtttgctctggcatcatactccatcatcttcctcaagctttcttcctaccgggatgtcaatctgtggtgccgccagcgaagggtcaaggccaaagctgtgtctgcagggaagaaggtcagtggggctgctgcccagaacactgtaagctatccggacaacctgacctaccgagatctctattacttcatctttgctcctactttgtgttatgaactcaactttcctcgatccccccgaatacgaaagcgctttctgctacggcgggttcttgagatgctctttttcacccagcttcaagtggggctgatccagcagtggatggtccctactatccagaactccatgaagcccttcaaggacatggactattcacgaatcattgagcgtctcttaaagctggcggtccccaaccatctgatatggctcatcttcttctattggcttttccactcatgtctcaatgctgtggcagagctcctgcagtttggagaccgcgagttctacagggactggtggaatgctgagtctgtcacctacttttggcagaactggaatatccccgtgcacaagtggtgcatcagacacttttacaagcctatgctcagactgggcagcaacaaatggatggccaggactggggtcttttgggcgtcagctttctttcatgagtacctagtgagcattcccctgaggatgttccgcctttgggcattcacagcaatgatggctcaggtcccactggcctggattgtgaaccgcttcttccaagggaactatggcaatgcagctgtgtgggtgacactcatcattgggcaaccggtggctgtgctcatgtatgtccacgactactacgtgctcaactatgatgccccagtgggggcatgagctactgccaaaggccagcctccctaacctgggcctggagttctggagggcttcctgctgctgcacactcccctagtttggaggcctttctgcccctatggggcctactcctgctcttggggatggccctgagccagctggttgagccagtgctgggagtttgtgctgaccaggggcttaggatatcaataaagagctatctaaaaaaaaaaaaaaaaa

SEQ ID NO: 346 - DNA, 3718 bp, Homo sapiens
cgcctcaggtcggccgcggactacaaatggacgagagaggcggccgtccattagttagcggctccggagcaacgcagccgttgtccttgaggccgacgggcctgacgcgggcgggttgaacgcgctggtgaggcggtcacccgggctacggcggccggcagggggcagtggcggccgttgtctagggcccggaggtggggccgcgcgcctcgggcgctacgaacccggcaggcccacgcttggctgcggccgggtgcgggctgaggccatgggcgaccgcggcagctcccggcgccggaggacagggtcgcggccctcgagccacggcggcggcgggcctgcggcggcggaagaggaggtgcgggacgccgctgcgggccccgacgtgggagccgcgggggacgcgccagccccggcccccaacaaggacggagacgccggcgtgggcagcggccactgggagctgaggtgccatcgcctgcaggattctttattcagctctgacagtggcttcagcaactaccgtggcatcctgaactggtgtgtggtgatgctgatcttgagcaatgcccggttatttctggagaacctcatcaagtatggcatcctggtggaccccatccaggtggtttctctgttcctgaaggatccctatagctggcccgccccatgcctggttattgcggccaatgtctttgctgtggctgcattccaggttgagaagcgcctggcggtgggtgccctgacggagcaggcgggactgctgctgcacgtggccaacctggccaccattctgtgtttcccagcggctgtggtcttactggttgagtctatcactccagtgggctccctgctggcgctgatggcgcacaccatcctcttcctcaagctcttctcctaccgcgacgtcaactcatggtgccgcagggccagggccaaggctgcctctgcagggaagaaggccagcagtgctgctgccccgcacaccgtgagctacccggacaatctgacctaccgcgatctctactacttcctcttcgcccccaccttgtgctacgagctcaactttccccgctctccccgcatccggaagcgctttctgctgcgacggatccttgagatgctgttcttcacccagctccaggtggggctgatccagcagtggatggtccccaccatccagaactccatgaagcccttcaaggacatggactactcacgcatcatcgagcgcctcctgaagctggcggtccccaatcacctcatctggctcatcttcttctactggctcttccactcctgcctgaatgccgtggctgagctcatgcagtttggagaccgggagttctaccgggactggtggaactccgagtctgtcacctacttctggcagaactggaacatccctgtgcacaagtggtgcatcagacacttctacaagcccatgcttcgacggggcagcagcaagtggatggccaggacaggggtgttcctggcctcggccttcttccacgagtacctggtgagcgtccctctgcgaatgttccgcctctgggcgttcacgggcatgatggctcagatcccactggcctggttcgtgggccgctttttccagggcaactatggcaacgcagctgtgtggctgtcgctcatcatcggacagccaatagccgtcctcatgtacgtccacgactactacgtgctcaactatgaggccccagcggcagaggcctgagctgcacctgagggcctggcttctcactgccacctcacacccgctgccagagcccacctctcctcctaggcctcgagtgctggggatgggcctggctgcacagcatcctcctctggtcccagggaggcctctctgcccctatggggctctgtcctgcacccctcagggatggcgacagcaggccagacacagtctgatgccagctgggagtcttgctgaccctgccccgggtccgagggtgtcaataaagtgctgtccagtgacctcttcagcctgccaggggcctggggcctggtggggggtatggccacacccacaagggcgagtgccagagctgtgtggacagctgtcccaggacctgccggggagcagcagctccactgcagcagggcgggcatggccggtagggggagtgcaaggccaggcagacgcccccattccccacactcccctacctagaaaagctcagctcaggcgtcctctcctggtgctactcctgctgggtgtgcgggaatcggcactctggccctcagtgcaggatggtcaacttgcacccaccgtgctcagcttcagcttgggaagaggtcggccctgggtttgcgggaagtgggctccagccaggatggcccagggatgggcagtccacagggcctttctggtgtgggtctggtgagccgaggggctacggtacacaatggctatgtccatggctattcgccttggggcagggctcggtttggcagcctctttccttcacttggaacctgggcagccaggtgggctggtggctctcagctgccctccacgaggttggggcacccctgatccccaggcctgccttgccctctgctcttctggcaccaggctgggcagtgcagacagcgcagccctgcagccttcaggacaccttgttcccaggccctgcaatccaccaagctggatagatggggccccccttgatggtagcgggaggtcaggggtaaccccagggccctgctgctgccttaccttgctggggtgactgcttgattaaagaccccaagactggaccaggccctggtgtccccagacctgcagctatggcccaacaaggcaggtgtttgaggaggccctgcacagggtcccaggactgcaccaggggcctcatcagcaacctgctgaactggtggtgtgaggggagggtgggctcccttggtggtatcctccctctaccccagtgggggctggtgggccctgagatggaggcatctccttgggccctgctgaggatggcagtagtgggtgagctcctggtggggggatgggtgtggggccgactcctccatcccacatgggctcctgtgcctctccctatcagttggccagtggagctcgagaacaaactgttgctgccagataaagcagcaaagcctgctccactgcccagcgcaggcccccttcccttcctccaccaggctgagtggagaaccctaaagctacgggacaggctcccgttccccgtgcctacacagggtgctggctctggcagaaagacagtgtgcccgccccgcatcacctgtccgagtgcgaacaccttgggaagggggttcctggtggtcctgtgacaaccagagacccccagggccaaggtgaggcgcccacccctggtccctcaataaagaactgcaagcacatgctggtcctggggagtcgggcaggcacggagctagctgcaagcatccgtcttcccccaggaggccactgcagcccggcccttctgtgccctgggcccctcctcattgcagcaccacccaccgcaccaccctgggacagaggaaacacatggaggccatagcatagagcctgtctgtttatagatctctgcctgtcttgtccgtccatccactgtgtgtatatatctgtgtatctctgtggagcggggaacgggacagttgtgtaaaaatccaaaatacaattctgactatgaacaaaaaaaaaaaaaaa

SEQ ID NO: 347 - protein, 508 aa, Aspergillus fumigatus
MKMSASKTVTSSASAVSTSSGRSTPSKLVNGATRNGSAAAGNGSTGTAKGKRRSKYRHVAAYHSELRHSSLSRETSVVPSFLGFRNLMVIVLVAMNLRLIIENFMKYGVLICIKCHDYRKQDVVLGSILFALVPCHLFLAYIIELVAAQQSKKTVGRQKKDLSTEEREREQQAFRSTWRYTAFFHTVNATLCLAVTSFVVYFYINHPGIGTICELHAIIVWLKNCSYAFTNRDLRQAMVDPSAESALPEIYSTCPYPRNITLGNLTYFWLAPTLVYQPVYPRSSHIRWSFVAKRLAEFFGLAVFIWLLSAQYAAPVLRNSIDKIAVMDIASILERVMKLSTISLVIWLAGFFALFQSLLNALAEVMRFGDREFYTDWWNSPSLGAYWRSWNRPVYLFMKRHVFSPLVGRGWSPFAASFMVFSLSAVLHEMLVGIPTHNLIGVAFAGMMFQLPLIAVTAPFEKVNDALGKIVGNSIFWVSFCLVGQPLGALLYFFAWQAKYGSVSKIHV

SEQ ID NO: 348 - protein, 521 aa, Ricinus communis
MTILETPETLGVISSSATSDLNLSLRRRRTSNDSDGALADLASKFDDDDDVRSEDSAENIIEDPVAAVTELATAKSNGKDCVANSNKDKIDSHGGSSDFKLAYRPSVPAHRSLKESPLSSDLIFKQSHAGLFNLCIVVLVAVNSRLIIENLMKYGWLIKTGFWFSSRSLRDWPLFMCCLSLPVFPLAAYLVEKAAYRKYISPPIVIFLHVIITSAAVLYPASVILSCESAFLSGVTLMELACMVWLKLVSYAHTNYDMRAIADTIHKEDASNSSSTEYCHDVSFKTLAYFMVAPTLCYQPSYPRTAFIRKGWVFRQFVKLIIFTGFMGFIIEQYINPIVQNSQHPLKGDLLYAIERVLKLSVPNLYVWLCLFYCFFHLWLNIVAELLRFGDREFYKDWWNAKTVEEYWRMWNMPVHKWMVRHIYFPCLRRKIPRGVAIVIAFFVSAVFHELCIAVPCHMFKLWAFFGIMFQIPLVVITNYFQRKFRSSMVGNMIFWFFFCILGQPMCVLLYYHDLMNRDGN

SEQ ID NO: 349 - protein, 526 aa, Vernicia fordii
MTIPETPDNSTDATTSGGAESSSDLNLSLRRRRTASNSDGAVAELASKIDELESDAGGGQVIKDPGAEMDSGTLKSNGKDCGTVKDRIENRENRGGSDVKFTYRPSVPAHRALKESPLSSDNIFKQSHAGLFNLCIVVLVAVNSRLIIENIMKYGWLIKTGFWFSSRSLRDWPLLMCCLTLPIFSLAAYLVEKLACRKYISAPTVVFLHILFSSTAVLYPVSVILSCESAVLSGVALMLFACIVWLKLVSYAHTNFDMRAIANSVDKGDALSNASSAESSHDVSFKSLVYFMVAPTLCYQPSYPRTASIRKGWVVRQFVKLIIFTGFMGFIIEQYINPIVQNSQHPLKGDLLYAIERVLKLSVPNLYVWLCMFYCFFHLWLNILAELLRFGDREFYKDWWNARTVEEYWRMWNMPVHKWMVRHIYFPCLRHKIPRGVALLITFFVSAVFHELCIAVPCHIFKLWAFIGIMFQIPLVGITNYLQNKFRSSMVGNMIFWFIFCILGQPMCLLLYYHDLMNRKGTTESR

SEQ ID NO: 350 - protein, 523 aa, Vernonia galamensis
MALLDTPQIGEITTTATTTIRRRTTVKPDAGIGDGLFDSSSSSKTNSSFEDGDSLNGDFNDKFKEQIGAGDESKDDSKGNGQKIDHGGVKKGRETTVVHYAYRPSSPAHRRIKESPLSSDAIFKQSHAGLFNLCIVVLVAVNGRLIIENLMKYGLLINSNFWFSSRSLRDWPLLMCCLTPSDFPLAAYIVEKLAWKKRISDPVVITLHVIITTTAILYPVFMILRFDSVVLSGVSLMLCACINWLKLVSFVHTNYDMRSLLNSTDKGEVEPMSSNMDYFYDVNFKSLVYFMVAPTLCYQISYPRTAFIRKGWVLRQLIKLVIFTGFMGFIIEQYINPIVKNSRHPLKGDFLYAIERVLKLSVPNLYVWLCMFYCFFHLWLNILAELLCFGDREFYKDWWNAQTIEEYWRLWNMPVHKWIVRHLYFPCLRNGIPKGAAILVAFFMSAVFHELCIAVPCHIFKFWAFIGIMFQVPLVLLTNYLQHKFQNSMVGNMIFWCFFSIFGQPMCVLLYYHDVMNQKGKSK

SEQ ID NO: 351 - protein, 517 aa, Vernonia galamensis
MALLDTPQIGEITTTATTTIRQHPLGKPDAGIGDGLFSSSSSKTNSSFEDGDSLNGDFNDKFKEQIGAGDESKKGNGKIDHGGVKKGRETTVVHYAYRPSSPAHRRIKESPLSSDAIFKQSHAGLFNLCIVVLVAVNGRLIIENLMKYGLLINSKFWFSSRSLRDWPLLMCWLTPSDFPLAAYIVEKLAWKKRISDPVVITLHVVITTTAILYPIFMILRFDSVVLLGVSLMLCACINWLKLVSFVHTNYDMRSLLNSTGKGEVEPMSSNMDYFYDINFKSLVYFMVAPTLCYQISYPRTAFIRKGWVFRQLIKLVIFTGFMGFIIEQYINPIVKNSRHPLNGDFLYAIERVLKVSVPNLYVWLCMFYCFFHLWLNILAELLWFGDREFYKDWWNTQTIEEYWRLWNMPVHKWIVRHLYFPCLRNGISKGAAILVAFFMSAVFHELCIAVPCHILKFWAFIGIMFQVPLVLLTNYLQHKFQNSMVGNMIFWCFFSIFGQPMCVFLYYHEVNQKGKSK

SEQ ID NO: 352 - protein, 507 aa, Euonymus alatus
MAANLNEASDLNFSLRRRTGGISSTTVPDSSSETSSSEADYLDGGKGAADVKDRGDGAVEFQNSMKNVERIEKHESRVGLDSRFTYRPSVPAHRTIKESPLSSDAIFKQSHAGLFNLCIVVLVAVNSRLIIENLMKYGWLIRSGFWFSSRSLRDWPLFMCCLTLPVFPLAAFLFEKLAQKNLISEPVVVLLHIVNTTAAVLYPVLVILRCDSAFMSGVTLMLFACIVWLKLVSYAHTNYDMRALTKSVEKGDTPLSSQNMDYSFDVNIKSLAYFMVAPTLCYQISYPRTPYVRKGWVVRQFVKLIIFTGLMGFIIEQYINPIVQNSQHPLKGNFLYAIERVLKLSVPNLYVWLCMFYCLFHLWLNILAELLCFGDREFYKDWWNAKTVEEYWRMWNMPVHKWMVRHIYFPCLRNGIPKGVAFVISFLVSAVFHELCIAVPCHIFKLWAFFGIMLQVPLVLITSYLQNKFRSSMVGNMMFWFSFCIFGQPMCLLLYYHDLMNRNGKME

SEQ ID NO: 353 - protein, 498 aa, Caenorhabditis elegans
MQMRQQTGRRRRQPSETSNGSLASSRRSSFAQNGNSSRKSSEMRGPCEKVVHTAQDSLFSTSSGWTNFRGFFNLSILLLVLSNGRVALENVIKYGILITPLQWISTFVEHHYSIWSWPNLALILCSNIQILSVFGMEKILERGWLGNGFAAVFYTSLVIAHLTIPVVVTLTHKWKNPLWSVVMMGVYVIEALKFISYGHVNYWARDARRKITELKTQVTDLAKKTCDPKQFWDLKDELSMHQMAAQYPANLTLSNIYYFMAAPTLCYEFKFPRLLRIRKHFLIKRTVELIFLSFLIAALVQQWVVPTVRNSMKPLSEMEYSRCLERLLKLAIPNHLIWLLFFYTFFHSFLNLIAELLRFADREFYRDFWNAETIGYFWKSWNIPVHRFAVRHIYSPMMRNNFSKMSAFFVVFFVSAFFHEYLVSVPLKIFRLWSYYGMMGQIPLSIITDKVVRGGRTGNIIVWLSLIVGQPLAILMYGHDWYILNFGVSAVQNQTVGI

SEQ ID NO: 354 - protein, 498 aa, Rattus norvegicus
MGDRGGAGSSRRRRTGSRVSVQGGSGPKVEEDEVREAAVSPDLGAGGDAPAPAPAPAHTRDKDRQTSVGDGHWELRCHRLQDSLFSSDSGFSNYRGILNWCVVMLILSNARLSLENLIKYGILVDPIQVVSLFLKDPYSWPAPCLIIASNIFIVATFQIEKRLSVGALTEQMGLLLHVVNLATIICFPAAVALLVESITPVGSLFALASYSIIFLKLSSYRDVNLWCRQRRVKAKAVSAGKKVSGAAAQNTVSYPDNLTYRDLYYFIFAPTLCYELNFPRSPRIRKRFLLRRVLEMLFFTQLQVGLIQQWMVPTIQNSMKPFKDMDYSRIIERLLKLAVPNHLIWLIFFYWLFHSCLNAVAELLQFGDREFYRDWWNAESVTYFWQNWNIPVHKWCIRHFYKPMLRLGSNKWMARTGVFWASAFFHEYLVSIPLRMFRLWAFTAMMAQVPLAWIVNRFFQGNYGNAAVWVTLIIGQPVAVLMYVHDYYVLNYDAPVGA

SEQ ID NO: 355 - protein, 488 aa, Homo sapiens
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 356 - protein, 11 aa, Artificial Sequence
  conserved sequence
  X (4)..(4): Threonine (T) or Serine (S)
RGVXRHRWTGR

SEQ ID NO: 357 - protein, 8 aa, Artificial Sequence
  conserved sequence
  X (1)..(1): Phenylalanine (F) or Tyrosine (Y)
XEAHLWDK

SEQ ID NO: 358 - protein, 9 aa, Artificial Sequence
  conserved sequence
DLAALKYWG

SEQ ID NO: 359 - protein, 8 aa, Artificial Sequence
  conserved sequence
  misc_feature (2)..(2): Xaa can be any naturally occurring amino acid
  X (5)..(5): Serine (S) or Alanine (A)
  X (8)..(8): any amino acid
SXGFXRGX

SEQ ID NO: 360 - protein, 14 aa, Artificial Sequence
  conserved sequence
  X (3)..(3): Histidine (H) or Gutamine (Q)
  X (6)..(6): Arginine (R) or Lysine (K)
  X (12)..(12): Arginine (R) or Lysine (K)
  misc_feature (13)..(13): Xaa can be any naturally occurring amino acid
HHXNGXWEARIGXV

SEQ ID NO: 361 - protein, 9 aa, Artificial Sequence
  conserved sequence
  X (7)..(7): any amino acid
QEEAAAXYD

SEQ ID NO: 362 - protein, 165 aa, Brassica napus
MGILRKKKHERKPSFKSVLTAILATHAATFLLLIAGVSLAGTAAAFIATMPLFVVFSPILVPAGITTGLLTTGLAAAGGAGATAVTIILWLYKRATGKAPPKVLEKVLKKIIPGAAAAPAAAPGAAPAAAPAAAPAVAPAAAPAAAPAPKPAAPPAPKPAAAPSI

SEQ ID NO: 363 - protein, 193 aa, Brassica napus
MADVRTHAHQVQVHPLRQQEGGIKVVYPQSGPSSTQVLAVIAGVPVGGTLLTLAGLTLAGSVIGLMLAFPLFLIFSPVIVPAAFVIGLAMTGFMASGAIGLTGLSSMSWVLNHIRRVRERMPDELEEAKQRLADMAEYVGQRTKDAGQTIEEKAHDVRESKTYDVRDRDTKGHTATGGDRDTKTTREVRVATT

SEQ ID NO: 364 - protein, 188 aa, Brassica napus
MANVDRRVNVDRTDKGLQLQPQYEDRVGYGYGYGGNTDYKSCGPSTNQIVALIAGVPIGGSLLALAGLTLAGSVIGFMLSIPLFLLFSPVIVPAALTIGLAVTGILASGLFGLTGLSSVSWVLNYIRGRSDTVPEQLDYAKRRMADAVGYAGQKGKEMGQYVQDKAHEAHDTSLTTETNGKTRRAHIA

SEQ ID NO: 365 - protein, 180 aa, Brassica napus
MADTARTHHDITSRDQYPILGRDRDQYPYGRSDYQTSGQDYSKTRQIAKAATAVTAGGSLLVLSSLTLVGTVIALTVATTLLVIFSPILVPALITVALLITGFLSSGGFGIADITVFSWIYKYATGEHPQGSDKLDSARMKLGTKAQDIKDRAQYYGQQHTGGEHDRDRTRGTHHTTTTT

SEQ ID NO: 366 - protein, 210 aa, Brassica napus
MADTHRVDRTDRHLQFQSPYEGGRVSIQYEGGGGAGGYGGRGGGYGAEGYKSMMPERGPSSTQVLSFLVGVPIVGSLLAIAGLLLAGSVIGLLISIPLFLLFSPVIVPAALTIGLAATGFLASGMFGLTGLSSVSWVLNYLRGTRKSSVPEQLEYAKKRMADAVGYAGQKGKGMGQHVQNKAQEAKQYDISKTHDTTTKGHETTQRTAAA

SEQ ID NO: 367 - protein, 149 aa, Brassica napus
MANQTRTHQDIIVRDSRITLDRDHPKTGAQMVKVATGVAAGGSLLVLSGLTLAGTVIAFAVATPLLIIFSPVLVPAVITVVLIITGFLASGGFGIAAITAFSWLYRHMTGSGSDQKIESARMKVGSRGYDTKYGQHNIGVHQQHQQAAS

SEQ ID NO: 368 - protein, 137 aa, Arachis hypogaea
MAEALYYGGRQRQEQPRSTQLVKATTAVVAGGSLLILAGLVLAGTVIGLTTITPLFVIFSPVLVPAVITVALLGLGFLASGGFGVAAITVLTWIYRYVTGKHPPGANQLDTARHKLMGKAREIKDFGQQQTSGAQAS

SEQ ID NO: 369 - protein, 150 aa, Arachis hypogaea
MTDRTQPHAVQVHTTAGRFGDTAAGTNRYADRGPSTSKVIAVITGLPIGGTLLLFAGLALAGTLLGLAVTTPLFILFSPVIVPATIVVGLSVAGFLTSGACGLTGLSSFSWVMNYIRQTHGSVPEQLEMAKHRMADVAGYVGQKTKDVGQ

SEQ ID NO: 370 - protein, 166 aa, Arachis hypogaea
MSDQTRTGYGGGGSYGSSYGGGGTYGSSYGTSYDPSTNQPIRQAIKFMTASTIGVSFLILSGLILTGTVIGLIIATPLLVIFSPILVPAAITLALAAGGFLFSGGCGVAAIAALSWLYSYVTGKHPAGSDRLDYAKGVIADKARDVKDRAKDYAGAGRAQEGTPGY

SEQ ID NO: 371 - protein, 176 aa, Arachis hypogaea
MATATDRAPHQVQVHTPTTQRVDVPRRGYDVSGGGIKTLLPERGPSTSQIIAVLVGVPTGGTLLLLSGLSLLGTIIGLAIATPVFIFFSPVIVPAVVTIGLAVTGILTAGACGLTGLMSLSWMINFIRQVHGTTVPDQLDSVKRRMADMADYVGQKTKDAGQEIQTKAQDVKRSSS

SEQ ID NO: 372 - protein, 153 aa, Ricinus communis
MADRPQPHQVQVHRYDPTTGYKGQQKGPSASKVLAVLTFLPVGGGLLSLSGITLTNTLIGMAIATPLFILFGPIILPAAVVIGLAMMAFMVAGALGLSGLTSQSWALKYFREGTAMPESLDQAKKRMQDMAGYVGMKTKEVGQDIQRKAQEGK

SEQ ID NO: 373 - protein, 138 aa, Ricinus communis
MAEHQQSPVVSHRPRVNQLVKAGTAATAGSSLLFLSGLTLTGTVIALALATPLMVLFSPVLLPAVIIISLIGAGFLTSGGFGFGAILVLSWIYRYVTGKQPPGAESLDQARLKLAGKAREMKDRAEQFGQHVTGQQTS

SEQ ID NO: 374 - protein, 226 aa, Glycine max
MTTQVPPHSVQVHTTTTHRYEAGVVPPGARFETSYEAGVKAASIYHSERGPTTSQVLAVLAGLPVGGILLLLAGLTLAGTLTGLAVATPLFVLFSPVLVPATVAIGLAVAGFLTSGAFGLTALSSFSWILNYIRETQPASENLAAAAKHHLAEAAEYVGQKTKEVGQKTKEVGQDIQSKAQDTREAAARDAREAAARDAREAAARDAKVEARDVKRTTVTATTATA

SEQ ID NO: 375 - protein, 223 aa, Glycine max
MTTVPPHSVQVHTTTHRYEAGVVPPARFEAPRYEAGIKAPSSIYHSERGPTTSQVLAVVAGLPVGGILLLLAGLTLAGTLTGLVVATPLFIIFSPVLIPATVAIGLAVAGFLTSGVFGLTALSSFSWILNYIRETQPASENLAAAAKHHLAEAAEYVGQKTKEVGQKTKEVGQDIQSKAQDTREAAARDARDAREAAARDARDAKVEARDVKRTTVTATTATA

SEQ ID NO: 376 - protein, 155 aa, Linum usitatissimum
MDQTHQTYAGTTQNPSYGGGGTMYQQQQPRSYQAVKAATAATAGGSLIVLSGLILTATVISLIIATPLLVIFSPVLVPALITVGLLITGFLASGGFGVAAVTVLSWIYRYVTGGHPAGGDSLDQARSKLAGKAREVKDRASEFAQQHVTGGQQTS

SEQ ID NO: 377 - protein, 180 aa, Linum usitatissimum
MADRTTQPHQVQVHTQHHYPTGGAFGRYEGVLKGGPYHQQGTGSGPSASKVLAVMTALPIGGTLLALAGITLAGTMIGLAITTPIFVICSPVLVPAALLIGFAVSAFLASGMAGLTGLTSLSWFARYLQQAGQGVGVGVPDSFDQAKRRMQDAAGYMGQKTKEVGQEIQRKSQDVKASDK

SEQ ID NO: 378 - protein, 181 aa, Helianthus annuus
TTTTYDRHFTTTQPHYRQDDRSRYDQQTHSQSTSRTLAIIALLPVGGILLGLAALTFIGTLIGLALATPLFVIFSPIIVPAVLTIGLAVTGFLASGTFGLTGLSSLSYLFNMVRQTAGSVPESLDYVKGTLQDAGEYAGQKTKDFGQKIQSTAHEMGDQGQVGVHAQVGGGKEGRKSGDRT

SEQ ID NO: 379 - protein, 156 aa, Zea mays
MADHHRGATGGGGGYGDLQRGGGMHGEAQQQQKQGAMMTALKAATAATFGGSMLVLSGLILAGTVIALTVATPVLVIFSPVLVPAAIALALMAAGFVTSGGLGVAALSVFSWMYKYLTGKHPPAADQLDHAKARLASKARDVKDAAQHRIDQAQGS

SEQ ID NO: 380 - protein, 244 aa, Brassica napus
VSKPDDCRRIVDETISHFGRLDHLVNNAGIMQISMFENIEEITRTRAVMDTNFWGSVYTTRAALPYLRQSNGKIVAMSSSAAWLTAPRMSFYNASKAALLNFFETLRIELGSDVHITIVTPGYIESELTQGKYFSGEGELVVNQDIRDVQIGAFPVTSVSGCAKGIVKGVCRKQRYVTEPSWFKVTYLWKVFCPELIEWGCRLLFLSGHGTSEKNALNKKILDIPGVRSALYPESIRTPEIKSE

SEQ ID NO: 381 - protein, 349 aa, Brassica napus
MELINDFLNLTAPFFTFFGLCFFLPPFYFFKFVQSIFSTIFSENVYGKVVLITGASSGIGEQLAYEYASKGACLALTARRKNRLEEVAEIAREVGSPNVVTVHADVSKPDDCRRIVDETISHFGRLDHLVNNAGIMQISMFENIEEITRTRAVMDTNFWGAVYTTRAALPYLRQSNGKIVAMSSSAAWLTAPRMSFYNASKAALLNFFETLRIELGSDVHITIVTPGYIESELTQGKYVSGEGELVVNQDIRDVQIGAFPVTSVSGRAKGIVKGVCRKERYVTEPSWFKVTYLWKVFCPELIEWGCRLMFLSGHGTPEENALNKKILDIPGVRSALYPEPIRTPEIKSE

SEQ ID NO: 382 - protein, 456 aa, Brassica napus
MVDLLNSVMNLVAPPATMVVMAFSWPLLCFITFSERLYNSYFVTEDMEDKVVVITGASPAIGEQIAYEYAKRGANLVLVARREQRLRVVSNNARQIGANHVIIIAADVVKEDDCRRFITQAVNYYGRVDHLVNSASLGHTFYFDEVSDTTVFPHLLDINFWGNVYPTYVALPHLQKTNGRIVVNASVENWLPLPRMSLYSAAKAALVNFYETLRFELNGDVGITIATHGWIGSEMSRGKFMLEEGAEMQWKEEREVPANGGPLEEFAKMIVAGACRGDAYVKFPNWYDVFLLYRVFTPNVLRWTFKLLLSSEGSRQSSLVGVGQGLPPEESSSQMKLMLEGGSPRVTASPPRYTPSPSPPHHTASPPRYTPSPSPPHHTSSPQRYTPSPSPPHYTSSRHRYTPSPSPPHYTESPPLYTESPPHYTTSPNWYTESPPRYTPSPSPPRFSRFNIQELP

SEQ ID NO: 383 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 384 - protein, 350 aa, Zea mays
MLGMSRTGLAGAALRVALTALLPLVLPAYYVYKLTTYLLGAVFPEDVAGKVVLITGASSGIGEHLAYEYAKRGAYLALVARREASLREVGDVALGLGSPGVLVLPADVSKPRDCEGFIDDTISYFGRLDHLVNNASIWQVCKFEEIQDVRHLRALMDINFWGHVYPTRLAIPHLRRSRGRIVGVTSNSSYIFIGRNTFYNASKAAALSFYDTLRMELGSDIRITEVVPGVVESEITKGKMLTKGGEMKVDQDERDAILGPTPAEPVGDFARTVVRDVCRGARYVFEPRWYMGVYLLRACLPEVLAWNSRLLTVDTVGASTTDTLGKWLVELPGVRRVVQPPSLRSPEIKD

SEQ ID NO: 385 - protein, 245 aa, Brassica napus
MGTATEIMERDAMATVAPYAPVTFHRRARVDLDDRLPKPYMPRALQAPDREHPYGTPGHKNYGLSVLQQHVAFFDIDDNGIIYPWETYSGLRMIGFNIIGSLIIAAVINLALSYATLPGWLPSPFFPIYIHNIHKSKHGSDSRTYDNEGRFMPVNLELIFSKYAKTLPDKLSLGELWDMTEGQRDAWDIFGWFASKIEWGLLYLLARDEEGFLSKEAIRRCFDGSLFEYCAKIYVGINEDKTAYY

SEQ ID NO: 386 - protein, 244 aa, Brassica napus
MVRESMGEESEAFATTAPLAPVTGERKVRNDLEETLPKPYLARALVAPDTEHPNGSEGHDSKGMSVTQQHVAFFDQNGDGIVYPWETYAGFRDLGFNPISSVFWAIFINFAFSYVTLPSWLPSPLLPVYIDNIHKAKHGSDSSTYDTEGRYVPVNLENIFSKYALTAPNKITLKELWNLTEGNRMAIDPFGWLANKVEWLLVYLLAKDEEGFVSKEAVRGVFDASFFEYCAKKNKEKADSRKQD

SEQ ID NO: 387 - protein, 245 aa, Sesamum indicum
MATHVLAAAAERNAALAPDAPLAPVTMERPVRTDLETSIPKPYMARGLVAPDMDHPNGTPGHVHDNLSVLQQHCAFFDQDDNGIIYPWETYSGLRQIGFNVIASLIMAIVINVALSYPTLPGWIPSPFFPIYLYNIHKAKHGSDSGTYDTEGRYLPMNFENLFSKHARTMPDRLTLGELWSMTEANREAFDIFGWIASKMEWTLLYILARDQDGFLSKEAIRRCYDGSLFEYCAKMQRGAEDKMK

SEQ ID NO: 388 - protein, 243 aa, Zea mays
MSSYSPPPPPPRDQSMDTEAPNAPITRERRLNPDLQEQLPKPYLARALEAVDPSHPQGTKGRDPRGMSVLQQHAAFFDRNGDGVIYPWETFQGLRAIGCGLTVSFAFSILINLFLSYPTQPGWLPSPLLSIRIDNIHKGKHGSDSETYDTEGRFDPSKFDAIFSKYGRTHPNAITRDELSSMLQGNRNTYDFLGWLAAAGEWLLLYSLAKDKDGLLQRETVRGLFDGSLFERLEDDNNKKKSS

SEQ ID NO: 389 - DNA, 737 bp, Brassica napus
gaattccattcaaactagtaaacaatggggatactcaggaagaaaaaacacgagcgaaagccgtcgtttaagagtgttttaaccgcaatattagctacacatgccgcaacattcctcttgttgatcgccggtgtatccctcgccggcacagccgccgcatttatcgctaccatgccactattcgtagtattcagtccgattctcgtaccagctggtattaccactggtttactgactacgggtttagcagccgccggtggcgccggcgcgactgctgtcaccatcatcctgtggctctacaagcgagcaacgggcaaggcgccgccaaaagtcctagaaaaagtcttgaaaaagataataccaggtgctgcagctgcaccagcagccgctccaggagccgctccagcagcggcgccagcagccgcaccagctgtggcgccagcagccgcaccagctgctgcgccagcacctaagccagcagccccaccagcacctaagccagcagccgcaccgagtatatgaaaagaagtggtgggcatgagtaaaggttgatatggaaaactggatacatagaaaaaagagtaatccaacttttaaaaaataaataacaacttcacgtggggatagaaaaattttcaaatattattttactaatggatgtcgcggtacaaaataataacaaatgtaagcctttttattgtatagtattttaagaacgaagctatgtagcgttgaca

SEQ ID NO: 390 - DNA, 837 bp, Brassica napus
tcttgcttttagtttcttgcgtaacaaagatttagcttggaggattaatggcggacgttcgcacacatgctcaccaggttcaagtgcaccctctacgccagcaggaaggaggcatcaaagtggtttatccccagagcgggccttcttccactcaggttctagcagtgatcgccggtgtaccggttggagggacgctgctaactctggccggtttaactttagccggttcggttataggactaatgctggcattcccgctgttcctcatcttcagtccggttatcgtaccagcggcctttgtgatcggtttagctatgacaggattcatggcgtcaggggcaatagggctcacgggactatcgtcgatgtcgtgggtactgaaccacatccgaagagtaagggaacgtatgccggatgagctggaggaagcaaagcagcgtttggctgacatggccgagtatgtggggcagaggacaaaagatgctggacagaccatagaagaaaaagctcacgatgtacgagagagcaagacttatgatgtccgagacagagacacaaagggtcatactgccacaggaggagacagggacaccaagacaactcgcgaggtccgagtggcgacaacatgaggcagcgtgtgttttgtggtgaataaaagagagtcgcctgttgtggttctggtttcttggtagataggtgttgtgtgttttaagcttaaaatggtgttctgctctgtaagcgttctttgagtgttgagtcaattttctttttctttttgtaataataataagtgaaaatgcatcttgtttagtagaaaaagaaaaaaaacaaaaaaaa

SEQ ID NO: 391 - DNA, 809 bp, Brassica napus
gtttagactttgctttttagtagttctagatcatatcaatcgctatggcaaatgtggacaggcgtgtgaatgtcgaccgtactgacaaaggacttcaacttcagccgcagtacgaagatcgtgtcggttatggatatggttatggtggtaatactgattacaagagttgcggcccttccactaaccaaatcgtggcacttatagcaggagttccaattggtggctcattgctagccttagctggactcactctagccggttcggtgataggttttatgctctccattccgctcttcctactcttcagtccggtgattgttccggcagctctcaccatcgggctagctgtaaccggaattttggcgtcagggttatttggtctgacgggtctcagctcggtctcgtgggtcctaaactacatccgtgggaggagtgatacggtgccggagcaattggactatgctaagaggcgtatggctgatgcagtaggctatgctggtcagaagggaaaagagatggggcagtatgtgcaggataaggctcatgaagcacatgatactagtctgaccactgagactaatggtaagacaaggagggcccatatagcgtaagtatgaaagcaccctctgttgtgggcttttgttggaaagacaattatgtaattttacttttgtgtcccagtttttttctcttagaatatattgtcaatgtgtaagttcgttttgtcgtgtccaaataaaatattttgtgggtgaaataagaaaagaactgttgtctgcaaaaaaaaaaaaaaaaaaaaaaaaaaaaaa

SEQ ID NO: 392 - DNA, 891 bp, Brassica napus
gccggggacttcaaaacataaactcatctctctcttcaacaagatcataatggcggatactgctagaactcatcacgacataaccagccgtgaccagtacccgatattgggccgagaccgagaccagtatccttacggacgatcagactaccagacgtcgggccaagactactccaagactaggcagattgctaaagctgctaccgcagtcaccgccggagggtcccttcttgtcctctccagtctcacccttgtcggaacagtcattgctttgactgttgccactactctgcttgttatctttagcccaatcctcgtgccggctctcatcaccgtagcacttctcatcactggctttctctcctctggtgggtttggcattgcagatataaccgtcttctcctggatctataagtacgcaacgggagagcacccacaggggtcagataagttggacagtgcaaggatgaagctgggaaccaaagctcaggatattaaagacagagctcaatactacggacagcaacatacaggtggtgagcatgaccgtgaccgtacccgtggaacccatcacaccaccactactacataaatcacgcaacagcccccagtaatgtcgatgtcaggggagtctagttcatgaggaataaggtgtttagaatttgatcagggtgggtaataaaaggggaagcatatatcatcagttttttttctttttttgttataaataatgtgcaagtgtgtttctcttgtcaaatggtaccatgttttgttgtgttattctctttgtggtaaattgtaaaccttttgttgtactttctttgccttgtttgtaagttgtaacgtctatatggagaagtcttgttcgtccaataaacaatagaacaaaaa

SEQ ID NO: 393 - DNA, 890 bp, Brassica napus
acgatcaaagaaaaactagacactactcaaaattatcttaatggcggatacacatcgcgtcgaccgtactgataggcacttgcaatttcagtcgccgtatgaaggcggacgagttagtattcagtatgaaggcggtggtggcgcaggcggctatggtggcaggggtggaggatacggtgctgaaggttacaaaagcatgatgcctgaacgtggcccatctagcacccaagtgttatcctttttggtgggggtccctatcgttggttcgctgcttgccatagccggtttacttttggcgggttcggtgataggtttactgatctctataccacttttcctcctcttcagcccggtcatagtcccagcggctctaaccatcgggcttgcagcgacaggattcttggcctctggaatgttcggtctaacggggcttagctcagtctcttgggtcctgaactaccttcgtgggaccaggaagagtagtgtgcctgagcagttggagtatgctaagaagagaatggcggatgctgttggctacgctggacagaagggaaaaggaatggggcagcacgtgcagaataaggcacaggaagctaaacagtatgatatctctaagacccatgatactactactaagggtcatgagactactcagaggacggccgcagcatgatgaagtcctgttttgagggcaagttatgtaactttcaccgtgatgtccttttacttctcctggacatttcactactacaatgttaagctcttttttgtttctaagtcaaaatcatgaaatgtagcgtctgtgtattttcatgcaagatcgcaagtggcgtacttgaatattcaataatttcttcgtacaaaaaaaaaaaaaaaaaaaaaaaaaaaaa

SEQ ID NO: 394 - DNA, 631 bp, Brassica napus
ggtgtcggagagatcataacaagaatcaatggcgaatcaaacaagaacccatcaagacataatagtccgagacagtagaattaccctagacagagaccatccgaagacaggggcgcagatggtgaaggtagcgactggtgtcgcagccggtggatccctcctagtcctctcaggcttaacactcgccggtacagtgatagcattcgctgtagccactcctctgcttattatatttagccctgtcttggtcccagcggtgatcaccgtggttctcatcatcactgggttccttgcctccggtggctttggtatagccgccataaccgccttctcttggctctacaggcacatgacggggtcaggatcggatcaaaagatagagagtgcccgaatgaaggtgggaagtagagggtatgataccaagtatgggcagcacaacattggagtccatcagcaacaccaacaagcagcttcttaaaattaatgtcagatagaactatttccacacaaattgtcatccatcgtttgatctcttttcttcgttttctcaatgcttgtgttgtaacgtaacgtgtaataataacatgtgtgtatgctgttaaaaaaaaaaaaaaaaaaaaaaaaaaaaaaa

SEQ ID NO: 395 - DNA, 655 bp, Arachis hypogaea
ttatggccggggattcgcattagcattagccctttcatttcacttcataattaattaataacatggctgaagcactctactacggcggccgccaacgccaagagcaaccaaggtccacccagcttgtcaaggccaccaccgctgttgtcgccggaggctccctcttgatcctcgccggccttgtgctggccggcaccgtcattggcctcacaacgatcacaccgctcttcgtgatcttcagcccggtgcttgtgccagctgtcatcactgtggcactcttaggcttggggttcttggcctctggaggcttcggcgtggcggcaataacagtgctgacgtggatctataggtacgtaacaggtaagcatccacctggcgccaaccaattggacacagcccgccacaagctgatgggcaaggcgcgtgagattaaggactttggtcaacaacaaaccagtggggcccaggcttcttgagcataccatcttcgtttgcatctttgtttgcacgcacgtccacgccatcatttatctttttcgaattgttatggtttattttattttatttaatttttttatgagtctggggtttccttgaaattaaccgttggtttaaaatattttccctgggttatccaatcccattcaaattttta

SEQ ID NO: 396 - DNA, 578 bp, Arachis hypogaea
ggtcacatgcatacacaaaccaaattaaatatcattccttctctttacctcttctccctgaaacctgcttcattcagagtaaaagaaacataaggaagaaaagggagcttcctgcaaccatcagccatgactgaccgtacccaaccacacgctgtccaagtccacaccacagctggccgtttcggcgacaccgctgccggaactaaccgctatgccgacagaggcccgtcaacatctaaggttatcgccgtcatcactggactccctatcggcggcacgttgctattgttcgcggggcttgcccttgccggaaccctgcttgggctggcggtgaccaccccgcttttcatcctcttcagccctgtcatagttccagccaccattgtcgttgggctctcggtggcggggttcttgacgtcaggtgcatgtgggctgacggggctgtcttcgttctcgtgggtcatgaattacatccggcagacccacggatcggtgccggagcagctggaaatggcaaagcaccgcatggctgacgtggccggttacgttggacagaagacgaaggatgtaggacagaa

SEQ ID NO: 397 - DNA, 647 bp, Arachis hypogaea
gaaaccccatcacttcttgtctaaaaattctcaaaagtcaccagccaccaaaaacccatttaccattatgtctgatcaaacaaggacaggctatggaggaggagggtcctatggatcatcctatggtggaggaggcacctatggttcatcttatggaacctcctatgaccccagtactaaccaacctatacgccaagccatcaagttcatgacagcatcaaccattggtgtctcattcttgatcctgtctgggttgatcctcactggaactgtcataggtttgatcattgcaacaccacttcttgttatcttcagtcctatccttgtccctgctgccataacccttgcactggctgctggtggatttttgttctctggtggctgtggtgttgctgccattgctgcattgtcatggttgtacagctatgtcactgggaaacaccctgctggctctgataggcttgattatgctaaaggggtgattgctgataaggctagggatgttaaggacagggccaaggattatgctggtgctggtagggctcaggagggcaccccagggtattgatcctcattgtgatgaaaaaaaatggaagcttttgtgtgtaatgtgtgggtgaagtgaaggtctgaaaggtgacaccccc

SEQ ID NO: 398 - DNA, 817 bp, Arachis hypogaea
tttttcgggatttgggggggttttttttttttttctgggaaagcgcccccttgttttggcccccggaaattggcccattagggccgggggaacaaaaggaatcccaaaaagggccttttcttttctcttaacaatcaaacaacagcaatggctactgctactgatcgtgcacctcaccaggttcaagttcacacccccaccacacaacgcgtcgacgttccacgccgcggctacgatgttagtggtggtggtattaagactcttctccccgagagaggtccgtccacctctcaaatcatcgccgtcctcgtcggcgtccccactgggggcactctgttgctcctctccggcctttcacttctcggaaccataatcgggctggcaattgccaccccggtttttatcttcttcagcccggttatagttcccgcggtcgttaccattggacttgcagtcactggtattctcacggcgggagcatgtggactaaccgggctgatgtctttgtcatggatgattaacttcatccgacaggtacatgggacgacggtgccggatcagctggactcagtgaagcggcgcatggcggacatggcggattacgtggggcagaagacaaaggatgctggccaagagatacagactaaggcccaggatgttaagaggtcatcatcataaagtaaaaaaaaaaaaaaaaaaaaaaaaaaagggggggcgccccccccccccccctatctaaaaaacaaaaaattttttgggggggggccccaaatgggttcctgggggcctaccccccaaggagaggggggaaaaaaaa

SEQ ID NO: 399 - DNA, 625 bp, Helianthus annuus
actaccaccacttacgaccgtcatttcaccaccacccaaccccactaccgccaagacgacaggtcccgctacgaccagcaaacccattcccagtccaccagcaggacactcgccatcatcgccctacttcctgtcggcggaatcttactcggcttagccgctctcacattcatcgggacgcttatcgggctcgccctcgccaccccgcttttcgtcatattcagcccgatcatcgtgccggccgttctaacaatcgggcttgctgttacaggctttttggcgtcggggacgttcgggttgacgggtttgagctcattgtcgtatttgttcaatatggttaggcagacggctgggtcggtgcccgagtccttggattatgttaaggggacgttgcaggatgccggtgagtatgccgggcagaagacgaaggatttcgggcagaagattcagagcacggctcatgagatgggtgatcaggggcaggttggtgttcatgctcaagttggtggcgggaaagaagggcgaaaaagcggtgatcggacttgaggattcaaggttgatattgtggaataataatgttgatgtaagtttttagtgttatcaaagctttgtttgtttgtttgta

SEQ ID NO: 400 - DNA, 471 bp, Zea mays
atggctgatcaccaccggggtgcgacgggaggtggcgggggctacggcgacctccagcgcgggggcggcatgcacggcgaggcgcagcagcagcagaagcagggcgccatgatgacggcgctcaaggccgcgacggccgcgaccttcggcgggtcgatgctggtgctgtccgggctgatcctggccggcaccgtgatcgcgctcacggtggccacccccgtgctggtgatcttcagcccggtgctggtgccggccgccatcgcgctggcgctcatggcggccgggttcgtcacctccggcggcctcggcgtcgctgcgctgtccgtgttctcctggatgtacaagtacctgacgggcaagcacccgccggccgccgaccagctggaccacgccaaggcgaggctggcgtccaaggcccgcgacgtcaaggatgcagcacagcaccgcatcgaccaggcgcaggggtcttga

SEQ ID NO: 401 - DNA, 890 bp, Brassica napus
gtttccaaacctgatgattgtagacgaatcgtcgatgagaccatctcccattttggcagattggatcatcttgtaaacaatgctggaataatgcagatttcaatgttcgaaaacattgaagaaataactaggacaagagcagttatggatactaacttttggggatcggtttatacaactcgtgctgcgcttccgtaccttcgacaaagcaatggtaagattgtggccatgtcgtcctctgcggcatggctaaccgccccaaggatgagcttttataatgctagcaaagccgcattgttgaacttcttcgagacgttgaggattgagcttggcagcgatgtacacattacaatcgtcacacctggttatattgaatctgaactcacacaaggcaagtacttctctggtgaaggcgagctagtagtcaaccaagacattagagatgttcaaattggagcatttccggtaacgtcggtatcaggttgtgccaaggggatagtgaaaggtgtgtgtaggaaacagagatacgtgaccgaaccatcgtggtttaaggtgacgtacctttggaaagtgttttgtccggaactgatcgagtggggttgcaggttgctgttcttgtccggacatggtacgtcggagaaaaatgcactcaacaagaagatcttggacatacctggtgtacgtagtgctctataccctgaatctatcagaacgccagaaatcaagtcggagtagagtgaggttgatacttaataagtgtctcatatagtggagccatgttttgtaaatggactttctattatgcacatgttactatgatgtatccgtttgtttatgtgtataagaataagtgaactttggagctccaaaaaaaaaaaaaaaaaaaaaaa

SEQ ID NO: 402 - DNA, 1266 bp, Brassica napus
ggtcgacggccattacggccgggatcccgttaatgtgtattgtgttttgatcgaagatggaattgataaacgatttcctcaatctaactgcacctttctttactttctttggtctttgcttcttcttgccccctttttatttcttcaagttcgtgcagtctatcttctcgacaattttctctgaaaacgtatatgggaaagtggttctcatcactggtgcttcctccgggatcggcgagcaattggcatatgagtacgcaagtaaaggtgcatgtttggctctgactgcccgaaggaagaaccgtctagaggaagtggcagagattgctcgtgaagttggatcccctaatgttgtcacagttcacgctgatgtttccaaacctgatgattgtagacgaatcgtcgatgagaccatctcccattttggcagattggatcatcttgtaaacaatgctggaataatgcaaatttcaatgttcgaaaacattgaagaaataactaggacaagagcagttatggatactaacttttggggagcggtttatacaactcgtgctgcgcttccgtaccttcgacaaagcaatggtaagattgtggctatgtcgtcctctgcggcatggctaaccgccccaaggatgagcttttataatgctagcaaagcagctttgttgaacttcttcgagacgttgaggattgagcttggtagcgatgtacacattacaatcgtcacacctggttatattgaatctgaactcacacaaggcaagtacgtctctggtgaaggcgagctagtagtcaaccaagacattagagatgttcaaattggagcatttccggtaacgtcagtatcaggtcgtgccaaggggatagtgaaaggtgtgtgtaggaaagagagatacgtgaccgaaccatcgtggtttaaggtgacgtacctttggaaagtgttttgtccggaactgatcgagtggggttgcagattgatgttcttgtccggacatggtacgccggaggaaaatgcactcaacaagaagatcctggacatacctggtgtacgtagtgctctataccctgaacctatcagaacgccagaaatcaagtcggagtagagtgaggttgatacttaataagtgtctcataaagtggagccatgttttgtaaatggactttctattatgcacatgttactatgatgtatctgtttgtttatgtgtataagaataagtgaactttggagctcaaaaaaaaaaaaaaaaaaaaaaaaaaaaa

SEQ ID NO: 403 - DNA, 1575 bp, Brassica napus
  misc_feature (1486)..(1488): n is a, c, g, or t
atagcctagtcccaaaaaaaactctgattgtgtcccaagtaaagagaaatggtggatctattgaactcggtgatgaatctggtggctccgccggccacgatggtggtgatggccttctcatggccattactgtgtttcattaccttctccgagcggctttataactcttattttgtgactgaagacatggaggataaagtcgtcgtcatcaccggagcttcccccgccatcggagagcaaatagcatacgaatatgcaaagaggggagcaaacttagtgttggtggcgaggagagagcaaagactgagagttgtgagcaacaacgccagacagattggagccaaccacgtcatcatcatcgctgctgatgtcgtcaaagaagatgattgccgccgtttcatcactcaagccgtcaactattacggtcgcgtggatcacctagtgaattcagcgagtcttggacacacgttttacttcgacgaagtgagtgacacgaccgtctttccgcatttgctggacataaacttctgggggaatgtctatccgacgtatgtagcgttgccacaccttcaaaagaccaatggccggatcgttgtgaacgcatcggtcgagaattggctgcctctaccgcggatgagtctttattccgctgcaaaagcggcactagtcaacttctacgagacgctgagattcgagctaaatggagatgtcggaataactatcgcgactcacgggtggatagggagtgagatgagtagaggaaagttcatgctagaagaaggtgccgagatgcagtggaaggaagaaagagaagtacctgcaaatggtggacctctagaggagtttgcaaagatgattgtggcaggagcttgcaggggagacgcatacgtgaagttcccaaactggtacgacgtgtttctcctctacagagtcttcacgccgaatgtgctgagatggacattcaagctgctgctctctagtgagggttcacgtcaaagctcccttgttggggtcgggcaaggtctgcctccagaggaatcctcttcacaaatgaaacttatgcttgaaggaggctcacctcgggtgactgctagcccacctcggtatactcccagtccaagcccacctcatcacactgctagcccacctcggtatactcccagtccaagcccacctcatcatacctcaagcccacaacggtatactcccagcccaagcccaccccattatacctcaagccgacatcgctataccccaagcccgagcccacctcattataccgaaagccctcctctgtataccgaaagtccacctcactataccacaagcccaaattggtataccgaaagccctcctcgatacaccccaagcccaagcccacctcggttttcacgttttaatatccaagagttaccataggaagtgaatggagaatcaagagtaagagtaaggatggtttggcgtgtagagtgagcttgagtttcannnctttctccaaattaggaagtcaacaaaagataaatgcaatgtaaaggacatagaatcaagaataatgcagctatgttgttacttgtc

SEQ ID NO: 404 - DNA, 1188 bp, zea mays
attgcgcacaccttgatgctgggcatgagcaggacggggttggccggagcggcgctgcgggtggcgctgacggcgctgctgccgctggtcctgccggcgtactacgtgtacaagctgaccacgtacctcctcggcgccgtcttccccgaggacgtcgccggcaaggtggtactcatcaccggcgcctcctccggcatcggcgagcacctggcctatgagtacgcgaagcggggagcctacctggcgctggtggcgaggagggaggcgagcctccgcgaggtcggcgacgtcgcgctggggctgggctcgccgggcgtcctcgtcctcccggctgacgtctccaagcctcgggactgcgagggcttcatcgacgacacgattagctacttcggtagactggatcacctggtgaacaacgcgtccatctggcaagtgtgcaagttcgaagagatccaggacgtcaggcacttgagagccctgatggacatcaacttctggggccacgtgtacccaacccggctcgccatccctcacctcaggagaagccgtggccggatcgtgggcgtcacctccaactcgtcctacatattcatcgggaggaacaccttctacaatgccagcaaggcggcggcgctcagcttctacgacaccctgaggatggagctgggcagcgacatccgcatcaccgaggtggtgccaggcgtggtggagtctgagatcaccaaggggaagatgctcaccaagggaggcgagatgaaggtggaccaggacgaaagagacgccatcctggggccgacgccggccgagcccgtgggcgacttcgccaggaccgtggtgcgcgacgtgtgccggggcgcgaggtacgtgttcgagcccaggtggtacatgggcgtctacttgctgcgggcctgcctcccggaagtcctggcctggaactcccgcctgctcactgtcgacacggtcggcgcgtccaccacggacacgctcggaaagtggctggtcgagctgcccggcgtgcgccgcgtcgtgcagccgccgtcgctccgctcgccggagatcaaggactagtgacggtgatcgtgtacgttctgtggccatggatagcactagctgtatgagaccgaagttcctttagacatcgacacgattaataaaggactcaattatcttaaaaaaaaaaaaaaaaaa

SEQ ID NO: 405 - DNA, 1022 bp, Brassica napus
attacggccggggattgcattcaatctagagaacaagaataacgagatgggtacggcgacggagataatggagagagacgcaatggctacggtggctccctacgctccggtcacttttcatcgccgtgctcgtgttgacttggatgatagacttcctaaaccatatatgccaagagccctgcaagcaccagatagagagcatccatatggaaccccaggccataagaattatggactaagtgttcttcaacaacatgtcgctttcttcgatatagatgataatggcattatctacccttgggagacctactctggactgcgaatgattggtttcaatatcattgggtcgcttatcatagctgctgtaatcaacctggcccttagctatgctactcttccgggatggttaccttcgccgttcttccctatatacatacacaacatacacaagtcaaagcatggaagcgactcaagaacatatgacaatgaagggaggtttatgccggtgaatcttgagttgatatttagcaaatatgcgaaaaccttgccagataaattgagtcttggagaattatgggacatgacagaaggacaacgtgacgcatgggacattttcggatggtttgcaagcaaaatagagtggggactgttgtacttgctagcgagggatgaagaagggtttttatcaaaagaagctattaggcggtgtttcgatgggagcttgttcgagtactgcgccaagatctacgttggtatcaatgaagacaagacagcgtactactaaagtaattgatcgagctgctttaggcttataatcgatccatatgtgttgttttgttatgtccaaatatttaaggtaaaatataagttgcagctctattaaaaagcttcaatgtggaataatagtatgttttgttgtttttctttttgtaccagcagtctctttttccatttatttccaatttaaatgcaattatgcagtgttgttgagcaaaaaaaaaaaaaaaaaaaaaaaaaaaaaa

SEQ ID NO: 406 - DNA, 1069 bp, Brassica napus
tcaattattaacacttacagaggagagagaaggagagccaaatggtaagagagagtatgggagaagagtccgaggcttttgccacgacggcgccgttagctccagtgaccggtgagcgaaaagtaaggaacgacttggaggaaacattaccaaaaccatatttggcaagagcactagtagctccagatacagagcatccgaatggatcagaaggtcatgacagcaaaggcatgagtgttacgcaacaacatgttgcttttttcgaccaaaacggcgatggaatcgtctatccttgggagacttatgcgggattccgtgacctcggtttcaacccaatctcttctgttttttgggccatattcataaactttgcgtttagctacgttacacttccgagttggttgccatcaccactattgcctgtttatatcgacaacattcacaaagccaagcatgggagtgattcaagcacctatgataccgaaggaaggtacgtcccggttaatctcgagaacatctttagcaaatatgcgttaacggctccaaataaaataacattaaaagagctttggaacttaaccgagggaaaccgaatggcaatcgatccttttggatggcttgcgaataaagttgaatggctactagtctatcttcttgcaaaggatgaggaagggttcgtgtctaaagaagctgtgagaggtgtctttgatgcaagtttctttgaatactgtgctaaaaagaataaagagaaggccgattctcgcaagcaagactaagcatttaatttgcttatcttttaaatttgtccgtttgtattattatgctctcaatcttaattaggaaaaggacagaaaacaaaactctatgtggaataaaacgtttgtgttcttggatatattgtgtgtatattgtgaataataaaatgagatttcatcattcggaaagtgaaatgatataattaaaacgaggagagagcatgaaacaatgtgtgcgcgcgctctctctagagagacaaatattagcgcggggggcgctcgtctttttttttcttaaaaaataaaaaaaaaaa

SEQ ID NO: 407 - DNA, 1030 bp, Sorghum indicum
ggcacgagagagaaaaaaggtgattttgtcaagggaaatatggcaactcatgttttggctgctgcggcggagagaaatgctgcgttggcgccggacgccccgcttgctccggtgactatggagcgcccagtgcgcactgacttggagacttcgatcccgaagccctatatggcaagaggattggttgcacctgatatggatcaccccaacggaacaccaggccatgtgcatgataatttgagtgtgctgcaacagcattgtgctttctttgatcaggatgataacggaatcatctatccatgggagacttactctggacttcgccaaattggtttcaatgtgatagcttcccttataatggctatcgtcattaatgtggcgctgagttatcctactctcccgggttggattccttctccttttttccccatatatttgtacaacatacacaaggccaaacatggaagcgactccggaacctatgatactgaaggaaggtacctacctatgaattttgagaacctgttcagcaagcatgcccggacaatgcccgataggctcactctaggggagctatggagcatgactgaagctaacagagaagcatttgacattttcggctggatcgcaagcaaaatggagtggactctcctctacattcttgcaagagaccaggacggtttcctgtcgaaagaagccatcaggcggtgttacgatggcagtttgttcgagtactgtgcaaagatgcaaaggggagccgaggacaagatgaaatgaaggaaatcggctatcgcggtaggtgtaagttatgatgtggtgtgtatgatggattgaaagtgccagtgcttaagttgtgtggcagagtcttgtgtaataacctttgtgtacagatttaaggtctcggaattggtgtaactgtggagaagatgttgactcctgtttttgttcaataagtccaactcttgacatttggttggtttgcagggaaagatggggaattttgttttccgaaaaaaaaaaaaaaaaaaaa

SEQ ID NO: 408 - DNA, 1326 bp, Zea mays
atcccagcagcaggtagcagcagcgcatgactttgtatctgcaactcgtttcgactagcctgcacgccgggagccctcgtctcgcccttctccacctccgaaggtagggtacctgatacttccctgccccgcgcatcgcatccgcggttttagtttgctggcctcggttccgatcgattcctatcctccctccgggcgggcgtccaccgacttcatcatccactcgccggccgaaccgatttgtttcgtttgccgttcgatccgcagatcctgcgagttcaacccgcgagtgagcatgtcgtcctactccccgccgccgccgccgccgcgggaccagtccatggacaccgaggcacccaacgcgcccatcaccagggagcggaggctcaaccccgatctgcaggagcagctccccaagccatatctcgcgagagctctcgaggcggtggacccgagccacccgcaggggaccaaggggcgcgacccccgcggcatgagcgtgcttcagcagcacgccgccttcttcgaccgcaatggcgacggcgtcatctacccctgggagacgtttcaaggactgcgagcgataggatgtggactcactgtatcattcgcgttctccatactgatcaacctcttcctcagttatcccactcagccgggatggttaccttctcctttgctgtccatccgtatagacaacatccacaagggtaagcacgggagtgattctgaaacctacgacactgaagggaggtttgatccatcaaagttcgatgctatattcagtaagtacggtcgaacccatcctaatgctataacaagagacgagttaagctcaatgcttcaaggaaaccgcaatacgtacgatttccttggctggttggccgctgccggtgaatggctcttactctacagcttggcgaaagacaaggatggcctcttgcagcgcgaaactgtccgtggtctatttgatgggagcctatttgagcgactggaagacgacaacaacaagaagaaatcgtcatgaatgctgagcagccttgtacagctcagggaagtgctgtcagtacaaaactaccagatataccattggtcgtgttcaaataacaaatgcttcggctttgttcatccgtcattaactatgagtgctgggatttgtttgtatgtgtgtcgtgctaccagtttcttctcctgtcgtctcacacaggtactgaattacgcatgtgttttctagtgttcgtgcggaagctgtattataagctgaaaaatgtgcgtttgaaatttatgggcaaaactgtcttcttggtcttaaaaaaaaaaaaaaaa

SEQ ID NO: 409 - DNA, 15172 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 410 - DNA, 17146 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 411 - DNA, 11142 bp, Artificial Sequence
  TDNA sequence
tcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtcc

SEQ ID NO: 412 - DNA, 13116 bp, Artificial Sequence
  TDNA sequence
tcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttggggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggttttttttaacggagcaagcggccgctgttcttctttactctttgtgtgactgaggtttggtctagtgctttggtcatctatatataatgataacaacaatgagaacaagctttggagtgatcggagggtctaggatacatgagattcaagtggactaggatctacaccgttggattttgagtgtggatatgtgtgaggttaattttacttggtaacggccacaaaggcctaaggagaggtgttgagacccttatcggcttgaaccgctggaataatgccacgtggaagataattccatgaatcttatcgttatctatgagtgaaattgtgtgatggtggagtggtgcttgctcattttacttgcctggtggacttggccctttccttatggggaatttatattttacttactatagagctttcataccttttttttaccttggatttagttaatatataatggtatgattcatgaataaaaatgggaaatttttgaatttgtactgctaaatgcataagattaggtgaaactgtggaatatatatttttttcatttaaaagcaaaatttgccttttactagaattataaatatagaaaaatatataacattcaaataaaaatgaaaataagaactttcaaaaaacagaactatgtttaatgtgtaaagattagtcgcacatcaagtcatctgttacaatatgttacaacaagtcataagcccaacaaagttagcacgtctaaataaactaaagagtccacgaaaatattacaaatcataagcccaacaaagttattgatcaaaaaaaaaaaacgcccaacaaagctaaacaaagtccaaaaaaaacttctcaagtctccatcttcctttatgaacattgaaaactatacacaaaacaagtcagataaatctctttctgggcctgtcttcccaacctcctacatcacttccctatcggattgaatgttttacttgtaccttttccgttgcaatgatattgatagtatgtttgtgaaaactaatagggttaacaatcgaagtcatggaatatggatttggtccaagattttccgagagctttctagtagaaagcccatcaccagaaatttactagtaaaataaatcaccaattaggtttcttattatgtgccaaattcaatataattatagaggatatttcaaatgaaaacgtatgaatgttattagtaaatggtcaggtaagacattaaaaaaatcctacgtcagatattcaactttaaaaattcgatcagtgtggaattgtacaaaaatttgggatctactatatatatataatgctttacaacacttggatttttttttggaggctggaatttttaatctacatatttgttttggccatgcaccaactcattgtttagtgtaatactttgattttgtcaaatatatgtgttcgtgtatatttgtataagaatttctttgaccatatacacacacacatatatatatatatatatatattatatatcatgcacttttaattgaaaaaataatatatatatatatagtgcattttttctaacaaccatatatgttgcgattgatctgcaaaaatactgctagagtaatgaaaaatataatctattgctgaaattatctcagatgttaagattttcttaaagtaaattctttcaaattttagctaaaagtcttgtaataactaaagaataatacacaatctcgaccacggaaaaaaaacacataataaatttgggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtcc

SEQ ID NO: 413 - DNA, 16749 bp, Artificial Sequence
  vector sequence
gcttcctcgtgctttacggtatcgccgctcccgattcgcagcgcatcgccttctatcgccttcttgacgagttcttctgaaacgcgtgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatcgacgtccgtacggttaaaaccaccccagtacattaaaaacgtccgcaatgtgttattaagttgtctaagcgtcaatttgtttacaccacaatatatcctgccaccagccagccaacagctccccgaccggcagctcggcacaaaatcaccactcgatacaggcagcccatcagtccactagacgctcaccgggctggttgccctcgccgctgggctggcggccgtctatggccctgcaaacgcgccagaaacgccgtcgaagccgtgtgcgagacaccgcagccgccggcgttgtggatacctcgcggaaaacttggccctcactgacagatgaggggcggacgttgacacttgaggggccgactcacccggcgcggcgttgacagatgaggggcaggctcgatttcggccggcgacgtggagctggccagcctcgcaaatcggcgaaaacgcctgattttacgcgagtttcccacagatgatgtggacaagcctggggataagtgccctgcggtattgacacttgaggggcgcgactactgacagatgaggggcgcgatccttgacacttgaggggcagagtgctgacagatgaggggcgcacctattgacatttgaggggctgtccacaggcagaaaatccagcatttgcaagggtttccgcccgtttttcggccaccgctaacctgtcttttaacctgcttttaaaccaatatttataaaccttgtttttaaccagggctgcgccctgtgcgcgtgaccgcgcacgccgaaggggggtgcccccccttctcgaaccctcccggcccgctctcgcgttggcagcatcacccataattgtggtttcaaaatcggctccgtcgatactatgttatacgccaactttgaaaacaactttgaaaaagctgttttctggtatttaaggttttagaatgcaaggaacagtgaattggagttcgtcttgttataattagcttcttggggtatttaaatactgtagaaaagaggaaggaaataataaatggctaaaatgagaatatcaccggaattgaaaaaactgatcgaaaaataccgctgcgtaaaagatacggaaggaatgtctcctgctaaggtatataagctggtgggagaaaatgaaaacctatatttaaaaatgacggacagccggtataaagggaccacctatgatgtggaacgggaaaaggacatgatgctatggctggaaggaaagctgcctgttccaaaggtcctgcaccttgaacggcatgatggctggagcaatctgctcatgagtgaggccgatggcgtcctttgctcggaagagtatgaagatgaacaaagccctgaaaagattatcgagctgtatgcggagtgcatcaggctctttcactccatcgacatatcggattgtccctatacgaatagcttagacagccgcttagccgaattggattacttactgaataacgatctggccgatgtggattgcgaaaactgggaagaagacaccccatttaaagatccgcgcgagctgtatgattttttaaagacggaaaagcccgaagaggaacttgtcttttcccacggcgacctgggagacagcaacatctttgtgaaagatggcaaagtaagtggctttattgatcttgggagaagcggcagggcggacaagtggtatgacattgccttctgcgtccggtcgatcagggaggatattggggaagaacagtatgtcgagctattttttgacttactggggatcaagcctgattgggagaaaataaaatattatattttactggatgaattgttttagtacctagatgtggcgcaacgatgctggcgacaagcaggagcgcaccgacttcttccgcatcaagtgttttggctctcaggccgaggcccacggcaagtatttgggcaaggggtcgctggtattcgtgcagggcaagattcggaataccaagtacgagaaggacggccagacggtctacgggaccgacttcattgccgataaggtggattatctggacaccaaggcaccaggcggatcaaatcaggaataagggcacattgccccggcgtgagtcggggcaatcccgcaaggagggtgaatgaatcggacgtttgaccggaaggcatacaggcaagaactgatcgacgcggggttttccgccgaggatgccgaaaccatcgcaagccgcaccgtcatgcgtgcgccccgcgaaaccttccagtccgtcggctcgatggcccagcaagctacggccaagatcgagcgcgacagcgtgcaactggctccccctgccctgcccgcgccatcggccgccgtggagcgttcgcgtcgtctcgaacaggaggcggcaggtttggcgaagtcgatgaccatcgacacgcgaggaactatgacgaccaagaagcgaaaaaccgccggcgaggacctggcaaaacaggtcagcgaggccaagcaagccgcgttgctgaaacacacgaagcagcagatcaaggaaatgcagctttccttgttcgatattgcgccgtggccggacacgatgcgagcgatgccaaacgacacggcccgctctgccctgttcaccacgcgcaacaagaaaatcccgcgcgaggcgctgcaaaacaaggtcattttccacgtcaacaaggacgtgaagatcacctacaccggcgtcgagctgcgggccgacgatgacgaactggtgtggcagcaggtgttggagtacgcgaagcgcacccctatcggcgagccgatcaccttcacgttctacgagctttgccaggacctgggctggtcgatcaatggccggtattacacgaaggccgaggaatgcctgtcgcgcctacaggcgacggcgatgggcttcacgtccgaccgcgttgggcacctggaatcggtgtcgctgctgcaccgcttccgcgtcctggaccgtggcaagaaaacgtcccgttgccaggtcctgatcgacgaggaaatcgtcgtgctgtttgctggcgaccactacacgaaattcatatgggagaagtaccgcaagctgtcgccgacggcccgacggatgttcgactatttcagctcgcaccgggagccgtacccgctcaagctggaaaccttccgcctcatgtgcggatcggattccacccgcgtgaagaagtggcgcgagcaggtcggcgaagcctgcgaagagttgcgaggcagcggcctggtggaacacgcctgggtcaatgatgacctggtgcattgcaaacgctagggccttgtggggtcagttccggctgggggttcagcagccagcgctttactgagatcctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttggatctcctgtggttggcatgcacatacaaatggacgaacggataaaccttttcacgcccttttaaatatccgattattctaataaacgctcttttctcttaggtttacccgccaatatatcctgtcaaacactgatagtttaaactgaaggcgggaaacgacaatctgctagtggatctcccagtcacgacgttgtaaaacgggcgtctgcgatcgctgaagttcctatacttttcagagaataggaacttcggaataggaacttcccatgggatctagtaacatagatgacaccgcgcgcgataatttatcctagtttgcgcgctatattttgttttctatcgcgtattaaatgtataattgcgggactctaatcataaaaacccatctcataaataacgtcatgcattacatgttaattattacatgcttaacgtaattcaacagaaattatatgataatcatcgcaagaccggcaacaggattcaatcttaagaaactttattgccaaatgtttgaacgatcacgctagcggataacaatttcacacagggatatcactagtaaaaggtaccgagctcctgcagtatcgatgcggccgcaaagtcgacgaattctcattagcagaactcaagatgctgatcctctggaacgttgaacttgagcttgtgttcctcgaaaagcttgcacaactctttgatgtaacgctggtgaagtctatcaacttcctctctagaaggctgaggagtcatttgaacctcgataggctttccaacgatagtagtgataggctgtctgaaaggcatgagtccgaaagagtattggaaaactccccttccatggaaaagtggaaggctgattcccataatcttttggagtctgttctggatccatctaagccaagttccaggagtgttctcaacctggttgaagaggttgttctctccgaatgagaagataggaacaagagcagcaccatgcataagagcaagtctgatgaatcccttacggttcttcaagagaagtctgtaagcaccaggtctagcatcaagagcctcttgagcacctccaacgatgatagcaagaaggtttccaccaccctttctgctaaggatgtgatcagcagaaactttctcgctagacacgagtccaccagacatgatgtaatctctgaagaatggagccctgaaccaaacggtaagcatcataaggtaggatctgattccagggaacaaagaggtgaatccagtagactcagtacagaggttaaggaaagcaccagcagcaagaacaccatgaggatggaatccagcaatgtagttacggctaggatcaagctcagcagtcttaacgagagacacagggaagtaatccttcatgtacttccagatggccaatcttctgaagaattggataggtctaccaccttgtctaggcttatcccaatccaagtaccaccaggtagcgtaaagaacagagaaaagccagaacctggtgaacaagagtccaacgaagataacgatgcagagttgagcaagagcaaggaatgagaaaacccactgaagaacagcgaaagtctgcaatcttctctcccaaggaacaagaagtggagcgaactcgaccatgaattcagtcccccgtgttctctccaaatgaaatgaacttccttatatagaggaagggtcttgcgaaggatagtgggattgtgcgtcatcccttacgtcagtggagatatcacatcaatccacttgctttgaagacgtggttggaacgtcttctttttccacgatgctcctcgtgggtgggggtccatctttgggaccactgtcggcagaggcatcttcaacgatggcctttcctttatcgcaatgatggcatttgtaggagccaccttccttttccactatcttcacaataaagtgacagatagctgggcaatggaatccgaggaggtttccggatattaccctttgttgaaaagtctcaattgccctttggtcttctgagactgtatctttgatatttttggagtagacaagtgtgtcgtgctccaccatgttgacgaagattttcttcttgtcattgagtcgtaagagactctgtatgaactgttcgccagtctttacggcgagttctgttaggtcctctatttgaatctttgactccatgggatccaagggccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcacacaaggtagttgcaagacactgaagtggtggtagtggtagtagaagaagcagaatcggtagaaaggcaagacaatggagaagatgaagatggtggagattctcttcccacaacgcagcaatcaaggttttcaaggttaaggcactcgtgctttccatcatcgaacatgaagtcgatgttatcctcgaaagcaagctcgttgaagagttctgggtactcaattgggttctcgttagcaaggttttgatcggtaaggaatggggagaatccagtatccatcatgcagaagttccaagcaagttcgttgttatctccgcacctatccatttccatgatggtggaagaatcaatgcagcagttaacaacggcagcttcctcagaatatcccacaatttcagcctcttgttgctcagccttctcttcctctttttcttcttcctcttgaggtggttcctcaacgtattgttgcttaacctcttccctaggttcctctttagcttctctagtctcaacctcttgcttagcctcaacaagaataccctcttgatggttagcctggttaactgggaatgggaaaacgcccttcttcttaagcctgtcgatgtagttggagatatcgaagttggtaacagcgttagcacctctgtactcaatagcagccatatcataagcagctgcagcctcttcttgagtgttgtaagttccgaggtagaggtacttgtttccgaaaactcttccaatcctagcttcccatcttccgttatgatgatgcctagcaactcccctatacttagaaactcccctagagaatccagatgactgccttctaagggaagcaagatactcttctttggtcaccctctgcatctcttcaagttctttggtgtaagtctcagctgggaagttaagaatggtatctgggccccaatacttaagagcagcaagatcataggtatgagcagcagcctcttcagaatcataagctccaaggtaaacctgcttgcccttcttgttttggatggagttccaagaggacttatcccaaaggtgagcttcgaatcttccagtccatctatgcctagtaacacctctgtagatagatgaccttctggtagaagctggagaagttgggttatgagacttatcgccagatggagatgacttcttagccctcttagctctctttggtcttggagcttcagattgaattgggctagaggtagtagtagaagaggacactgaagaagatggagaactagagcaggtagaggtagtgagcctcttcttcatgaattcactagtgattaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaaatcgaattcccgcggcccctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatcacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgcggccgcttcattactcgagccaggaggatggatcgatgctggtctgagaccctgctaccggttgctgactgaactgctcggcacggtccttcatttcacgggccttgctcgccaactttgtcttggccgactccaactgatccgctccgggtggatgtttccccgtcaggtaacggtagatccaggacagcacagacagagcggcaacaccaaatcccccgcttgccagaaaacccgctcccaacaggaagatggtgatgactgcagatcagaaaaactcagattaatcgacaaattcgatcgcacaaactagaaactaacaccagatctagatagaaatcacaaatcgaagagtaattattcgacaaaactcaaattatttgaacaaatcggatgatatctatgaaaccctaatcgagaattaagatgatatctaacgatcaaacccagaaaatcgtcttcgatctaagattaacagaatctaaaccaaagaacatatacgaaattgggatcgaacgaaaacaaaatcgaagattttgagagaataaggaacacagaaatttacctgcagggaccagtacaggcgagaagatcaccaggagaggtgtggcgattgtcagcgcaatgaccgttccagccagggtcaacccggataacaccaacaggctacctccggcagtaaccgcggtcgctgcctttacaacacgctgagcacgcggttgcagttgcaagtggggggcacgtgtttgttgctgctgcccgtagtgctctgccatggaaattttgttggtgctttgagcatataacaagcatggtatatataggcacgtaaacaagttgagaaattttactttgagtttgacataaccaataaaagttagtgctgtttattacctcactcagtttgcaccgcaactgtcgttagtgatgtttacctttcctttttctattatttattagtattatataatatatatatatgtgtgatgagacttgaaattgtttagcaccgcaaatgtccttcttgaggggaggttttcttttgctgaggttggggtgtcacatacacccccctctatggactcaacgtccttgctgaggtttaccccacactacatgagatttttctagactcaatactatgatatttctcgccttatcggaattggttaaactcagttgaagttagggtcatatcgataaaattgacacatgatcgactctgatattaaacagattctctccctcgaacctcactcactttcctttttctattctttattagtattatataatagatccgttccaaccattcacgtacataagaagagagatatttttttttaatggactaacatgacaaataaaacaaacaaaggagtaatgatcactacaacaaattagattatgagggacaaataatttcatcatctataaatcatgtttcgtcactaaaaattttgtgtgacgaaaaagatttcgtcaatcagttgtcactaaaaatatacaaagacgatttaatgatgtttacctttccttttctattctttattagtattatataataaatatatgtgtgatgagacttgaaattgtttagcaccgcaaatgtccttgttgaagggaggttttcttttgctgaggttggggtgtcacatacaccccctctatggactgaacgtcctttttgaggtttattttacactgcatgagatttttctagattcaacattatgatttctagactcaacactacgatcgtcactaaagactattttttatatataaaaaaaatactttgtccttaaatgtataaattagggataaatttattattataaaaaaggttaataattttgtgattaaatctattattttgtcactgaaagtgtttgcttttaccgacgacatatatgtcactaaatattatcataagtagtgacaattacaattgtcacaaaataaaaaaaattattcatattcaacaaaaaagggtactacgacaatacattttttgtcactgaaagtaatcaagttgtgataaattaatttatttaatgacaaaaatatttgtatcaaaattcacccatgatcatataataaaaataactaaaattatactaaagcataaatgacaagaaaatctaactaaaacatatcaaatattactcctaaacaaagacatataagtaaaaatttcttccaaagtatcaataacgtggtgacacatagcttgcaatcaatcttgcttcaattttcaccttttatacctgtaaaaagaaagagaaaataaaacaatgatttaaaggcgcgccgcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctgcgatcgcatggcgattttggattctgctggcgttactacggtgacggagaacggtggcggagagttcgtcgatcttgataggcttcgtcgacggaaatcgagatcggattcttctaacggacttcttctctctggttccgataataattctccttcggatgatgttggagctcccgccgacgttagggatcggattgattccgttgttaacgatgacgctcagggaacagccaatttggccggagataataacggtggtggcgataataacggtggtggaagaggcggcggagaaggaagaggaaacgccgatgctacgtttacgtatcgaccgtcggttccagctcatcggagggcgagagagagtccacttagctccgacgcaatcttcaaacagagccatgccggattattcaacctctgtgtagtagttcttattgctgtaaacagtagactcatcatcgaaaatcttatgaagtatggttggttgatcagaacggatttctggtttagttcaagatcgctgcgagattggccgcttttcatgtgttgtatatccctttcgatctttcctttggctgcctttacggttgagaaattggtacttcagaaatacatatcagaacctgttgtcatctttcttcatattattatcaccatgacagaggttttgtatccagtttacgtcaccctaaggtgtgattctgcttttttatcaggtgtcactttgatgctcctcacttgcattgtgtggctaaagttggtttcttatgctcatactagctatgacataagatccctagccaatgcagctgataaggccaatcctgaagtctcctactacgttagcttgaagagcttggcatatttcatggtcgctcccacattgtgttatcagccaagttatccacgttctgcatgtatacggaagggttgggtggctcgtcaatttgcaaaactggtcatattcaccggattcatgggatttataatagaacaatatataaatcctattgtcaggaactcaaagcatcctttgaaaggcgatcttctatatgctattgaaagagtgttgaagctttcagttccaaatttatatgtgtggctctgcatgttctactgcttcttccacctttggttaaacatattggcagagcttctctgcttcggggatcgtgaattctacaaagattggtggaatgcaaaaagtgtgggagattactggagaatgtggaatatgcctgttcataaatggatggttcgacatatatacttcccgtgcttgcgcagcaagataccaaagacactcgccattatcattgctttcctagtctctgcagtctttcatgagctatgcatcgcagttccttgtcgtctcttcaagctatgggcttttcttgggattatgtttcaggtgcctttggtcttcatcacaaactatctacaggaaaggtttggctcaacggtggggaacatgatcttctggttcatcttctgcattttcggacaaccgatgtgtgtgcttctttattaccacgacctgatgaaccgaaaaggatcgatgtcatgagcgatcgcgatcgttcaaacatttggcaataaagtttcttaagattgaatcctgttgccggtcttgcgatgattatcatataatttctgttgaattacgttaagcatgtaataattaacatgtaatgcatgacgttatttatgagatgggtttttatgattagagtcccgcaattatacatttaatacgcgatagaaaacaaaatatagcgcgcaaactaggataaattatcgcgcgcggtgtcatctatgttactagatccctgcagggcgtattggctagagcagcttgccaacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgataacatggtggagcacgacactctcgtctactccaagaatatcaaagatacagtctcagaagaccaaagggctattgagacttttcaacaaagggtaatatcgggaaacctcctcggattccattgcccagctatctgtcacttcatcaaaaggacagtagaaaaggaaggtggcacctacaaatgccatcattgcgataaaggaaaggctatcgttcaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagaccttcctctatataaggaagttcatttcatttggagaggacacgctgaaatcaccagtctctctctacaaatctatctctctcgagatgattgaacaagatggattgcacgcaggttctccggccgcttgggtggagaggctattcggctatgactgggcacaacagacaatcggctgctctgatgccgccgtgttccggctgtcagcgcaggggaggccggttctttttgtcaagaccgacctgtccggtgccctgaatgaacttcaagacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgactcatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgacc

SEQ ID NO: 414 - DNA, 137 bp, Artificial Sequence
  linker sequence
atttaaatgcggccgcgaattcgtcgattgaggacgtccctactagacctgctggacctcctcctgctacttactacgattctctcgctgtgcatatggtcagtcatgcccgggcctgcaggcggccgcatttaaat

SEQ ID NO: 415 - DNA, 9734 bp, Artificial Sequence
  synthesized DNA fragment
cctgcagggcgatcgcttgaaacatccctgaagtgtctcattttattttatttattctttgctgataaaaaaataaaataaaagaagctaagcacacggtcaaccattgctctactgctaaaagggttatgtgtagtgttttactgcataaattatgcagcaaacaagacaactcaaattaaaaaatttcctttgcttgtttttttgttgtctctgacttgactttcttgtggaagttggttgtataaggattgggacaccattgtccttcttaatttaattttattctttgctgataaaaaaaaaaatttcatatagtgttaaataataatttgttaaataaccaaaaagtcaaatatgtttactctcgtttaaataattgagattcgtccagcaaggctaaacgattgtatagatttatgacaatatttacttttttatagataaatgttatattataataaatttatatacatatattatatgttatttattattattttaaatccttcaatattttatcaaaccaactcataattttttttttatctgtaagaagcaataaaattaaatagacccactttaaggatgatccaacctttatacagagtaagagagttcaaatagtaccctttcatatacatatcaactaaaatattagaaatatcatggatcaaaccttataaagacattaaataagtggataagtataatatataaatgggtagtatataatatataaatggatacaaacttctctctttataattgttatgtctccttaacatcctaatataatacataagtgggtaatatataatatataaatggagacaaacttcttccattataattgttatgtcttcttaacacttatgtctcgttcacaatgctaaggttagaattgtttagaaagtcttatagtacacatttgtttttgtactatttgaagcattccataagccgtcacgattcagatgatttataataataagaggaaatttatcatagaacaataaggtgcatagatagagtgttaatatatcataacatcctttgtttattcatagaagaagtgagatggagctcagttattatactgttacatggtcggatacaatattccatgctctccatgagctcttacacctacatgcattttagttcatacttcatatgtcactcgacaaactcaagctccttgaccctgtccttggcgtagatgtccttgtacctgtcatagaggtcctgcacagcgtgcatgtaagagtcatggagctccctgatgatctcatccttggtctgaccgtacttgatagatgggactgggattggcttacccacaatggtgtaaattgggtgcctgtgtgggaggagaccaaagtcgtagttgaacacaccccttccatggaagagtggcatggtgaaaccaagagcatgctggatcttcttctgccacctgtgaagcttagagttctcattgctctcaatctgctcataaagctcattctcaccaaaggagatggtagggacaaggctagcaccagtctgcacagcaatcttgatgaaaccaaacctcctcttcaacacaaggtccatcactcctggtctggcgttcaaggactcagaggcacctcccaccacaatagcaatggaccttcctggaccacccttggtgaggatgttctggcaggaggtcttagacactgagcagagtccacaggccatgaggtaatccctgtagagtgggatgttgaagttgctggtgagggtgagcaaggaaggcctgattcctgggaagaggtcatcgaaaccagtagcgttggtggagaaggtgcagaagctacccatgctgatgataccatgtgggtggtaaccaaagatgtagttcttggatgggtcaaggtcagcctccttgataacatgagctgggaagtatccagcaaagagcttccaccaagctgcgttcctgagccacctgataggtctgcctccgttctcaggggccttatcccacaccaaaatccaggtcaagtagaggataattgggaaccaaaggagcacagggatgctgcagaggaagaagaagatgaacatgcagatgctcatcatggagcaccagaggagaacagcaagggtttggagccttctcctaagtgggaccctgagtggagcatacctaggggatgggatggcctcaagggtgtgcttcaccttctgttggaggtgctggtccttgctagccatatggtaattgtaaatgtaattgtaatgttgtttgttgtttgttgttgttggtaattgttgtaaaaagtatatcttaaattctttaatacggtgtactaggatattgaactggttcttgatgatgaaaacctgggccgagattgcagctatttatagtcataggtcttgttaacatgcatggacatttggccacggggtggcatgcagtttgacgggtgttgaaataaacaaaaatgaggtggcggaagagaatacgagtttgaggttgggttagaaacaacaaatgtgagggctcatgatgggttgagttggtgaatgttttgggctgctcgattgacacctttgtgagtacgtgttgttgtgcatggcttttggggtccagtttttttttcttgacgcggcgatcctgatcagctagtggataagtgatgtccactgtgtgtgattgcgtttttgtttgaattttatgaacttagacattgctatgcaaaggatactctcattgtgttttgtcttcttttgttccttggctttttcttatgatccaagagactagtcagtgttgtggcattcgagactaccaagattaattatgatgggggaaggataagtaactgattagtacggactgttaccaaattaattaataagcggcaaatgaagggcatggatgcgatcgcgcggccgctcctcgaagagaagggttaataacacattttttaacatttttaacacaaattttagttatttaaaaatttattaaaaaatttaaaataagaagaggaactctttaaataaatctaacttacaaaatttatgatttttaataagttttcaccaataaaaaatgtcataaaaatatgttaaaaagtatattatcaatattctctttatgataaataaaaagaaaaaaaaaataaaagttaagtgaaaatgagattgaagtgactttaggtgtgtataaatatatcaaccccgccaacaatttatttaatccaaatatattgaagtatattattccatagcctttatttatttatatatttattatataaaagctttatttgttctaggttgttcatgaaatatttttttggttttatctccgttgtaagaaaatcatgtgctttgtgtcgccactcactattgcagctttttcatgcattggtcagattgacggttgattgtatttttgttttttatggttttgtgttatgacttaagtcttcatctctttatctcttcatcaggtttgatggttacctaatatggtccatgggtacatgcatggttaaattaggtggccaactttgttgtgaacgatagaattttttttatattaagtaaactatttttatattatgaaataataataaaaaaaatattttatcattattaacaaaatcatattagttaatttgttaactctataataaaagaaatactgtaacattcacattacatggtaacatctttccaccctttcatttgttttttgtttgatgactttttttcttgtttaaatttatttcccttcttttaaatttggaatacattatcatcatatataaactaaaatactaaaaacaggattacacaaatgataaataataacacaaatatttataaatctagctgcaatatatttaaactagctatatcgatattgtaaaataaaactagctgcattgatactgataaaaaaatatcatgtgctttctggactgatgatgcagtatacttttgacattgcctttattttatttttcagaaaagctttcttagttctgggttcttcattatttgtttcccatctccattgtgaattgaatcatttgcttcgtgtcacaaatacaatttagctaggtacatgcattggtcagattcacggtttattatgtcatgacttaagttcatggtagtacattacctgccacgcatgcattatattggttagatttgataggcaaatttggttgtcaacaatataaatataaataatgtttttatattacgaaataacagtgatcaaaacaaacagttttatctttattaacaagattttgtttttgtttgatgacgttttttaatgtttacgctttcccccttcttttgaatttagaacactttatcatcataaaatcaaatactaaaaaaattacatatttcataaataataacacaaatatttttaaaaaatctgaaataataatgaacaatattacatattatcacgaaaattcattaataaaaatattatataaataaaatgtaatagtagttatatgtaggaaaaaagtactgcacgcataatatatacaaaaagattaaaatgaactattataaataataacactaaattaatggtgaatcatatcaaaataatgaaaaagtaaataaaatttgtaattaacttctatatgtattacacacacaaataataaataatagtaaaaaaaattatgataaatatttaccatctcataagatatttaaaataatgataaaaatatagattattttttatgcaactagctagccaaaaagagaacacgggtatatataaaaagagtacctttaaattctactgtacttcctttattcctgacgtttttatatcaagtggacatacgtgaagattttaattatcagtctaaatatttcattagcacttaatacttttctgttttattcctatcctataagtagtcccgattctcccaacattgcttattcacacaactaactaagaaagtcttccatagccccccaagaattcttttacaacaattaccaacaacaacaaacaacaaacaacattacaattacatttacaattaccaaatgaagaagaggctcactacctctacctgctctagttctccatcttcttcagtgtcctcttctactactacctctagcccaattcaatctgaagctccaagaccaaagagagctaagagggctaagaagtcatctccatctggcgataagtctcataacccaacttctccagcttctaccagaaggtcatctatctacagaggtgttactaggcatagatggactggaagattcgaagctcacctttgggataagtcctcttggaactccatccaaaacaagaagggcaagcaggtttaccttggagcttatgattctgaagaggctgctgctcatacctatgatcttgctgctcttaagtattggggcccagataccattcttaacttcccagctgagacttacaccaaagaacttgaagagatgcagagggtgaccaaagaagagtatcttgcttcccttagaaggcagtcatctggattctctaggggagtttctaagtataggggagttgctaggcatcatcataacggaagatgggaagctaggattggaagagttttcggaaacaagtacctctacctcggaacttacaacactcaagaagaggctgcagctgcttatgatatggctgctattgagtacagaggtgctaacgctgttaccaacttcgatatctccaactacatcgacaggcttaagaagaagggcgttttcccattcccagttaaccaggctaaccatcaagagggtattcttgttgaggctaagcaagaggttgagactagagaagctaaagaggaacctagggaagaggttaagcaacaatacgttgaggaaccacctcaagaggaagaagaaaaagaggaagagaaggctgagcaacaagaggctgaaattgtgggatattctgaggaagctgccgttgttaactgctgcattgattcttccaccatcatggaaatggataggtgcggagataacaacgaacttgcttggaacttctgcatgatggatactggattctccccattccttaccgatcaaaaccttgctaacgagaacccaattgagtacccagaactcttcaacgagcttgctttcgaggataacatcgacttcatgttcgatgatggaaagcacgagtgccttaaccttgaaaaccttgattgctgcgttgtgggaagagaatctccaccatcttcatcttctccattgtcttgcctttctaccgattctgcttcttctactaccactaccaccacttcagtgtcttgcaactaccttgtgtgagaattcgacacaagtgtgagagtactaaataaatgctttggttgtacgaaatcattacactaaataaaataatcaaagcttatatatgccttccgctaaggccgaatgcaaagaaattggttctttctcgttatcttttgccacttttactagtacgtattaattactacttaatcatctttgtttacggctcattatatccggtctagaggatccaaggccgcgaagttaaaagcaatgttgtcacttgtcgtactaacacatgatgtgatagtttatgctagctagctataacataagctgtctctgagtgtgttgtatattaataaagatcatcactggtgaatggtgatcgtgtacgtaccctacttagtaggcaatggaagcacttagagtgtgctttgtgcatggccttgcctctgttttgagacttttgtaatgttttcgagtttaaatctttgcctttgcgcggccgcatttaaatcatccatgcccttcatttgccgcttattaattaatttggtaacagtccgtactaatcagttacttatccttcccccatcataattaatcttggtagtctcgaatgccacaacactgactagtctcttggatcataagaaaaagccaaggaacaaaagaagacaaaacacaatgagagtatcctttgcatagcaatgtctaagttcataaaattcaaacaaaaacgcaatcacacacagtggacatcacttatccactagctgatcaggatcgccgcgtcaagaaaaaaaaactggaccccaaaagccatgcacaacaacacgtactcacaaaggtgtcaatcgagcagcccaaaacattcaccaactcaacccatcatgagccctcacatttgttgtttctaacccaacctcaaactcgtattctcttccgccacctcatttttgtttatttcaacacccgtcaaactgcatgccaccccgtggccaaatgtccatgcatgttaacaagacctatgactataaatagctgcaatctcggcccaggttttcatcatcaagaaccagttcaatatcctagtacaccgtattaaagaatttaagatatactctcgagttttacaacaattaccaacaacaacaaacaacaaacaacattacaattacatttacaattaccaaatggtcgagttcgctccacttcttgttccttgggagagaagattgcagactttcgctgttcttcagtgggttttctcattccttgctcttgctcaactctgcatcgttatcttcgttggactcttgttcaccaggttctggcttttctctgttctttacgctacctggtggtacttggattgggataagcctagacaaggtggtagacctatccaattcttcagaagattggccatctggaagtacatgaaggattacttccctgtgtctctcgttaagactgctgagcttgatcctagccgtaactacattgctggattccatcctcatggtgttcttgctgctggtgctttccttaacctctgtactgagtctactggattcacctctttgttccctggaatcagatcctaccttatgatgcttaccgtttggttcagggctccattcttcagagattacatcatgtctggtggactcgtgtctagcgagaaagtttctgctgatcacatccttagcagaaagggtggtggaaaccttcttgctatcatcgttggaggtgctcaagaggctcttgatgctagacctggtgcttacagacttctcttgaagaaccgtaagggattcatcagacttgctcttatgcatggtgctgctcttgttcctatcttctcattcggagagaacaacctcttcaaccaggttgagaacactcctggaacttggcttagatggatccagaacagactccaaaagattatgggaatcagccttccacttttccatggaaggggagttttccaatactctttcggactcatgcctttcagacagcctatcactactatcgttggaaagcctatcgaggttcaaatgactcctcagccttctagagaggaagttgatagacttcaccagcgttacatcaaagagttgtgcaagcttttcgaggaacacaagctcaagttcaacgttccagaggatcagcatcttgagttctgctaatgactcgagaagtatgaactaaaatgcatgtaggtgtaagagctcatggagagcatggaatattgtatccgaccatgtaacagtataataactgagctccatctcacttcttctatgaataaacaaaggatgttatgatatattaacactctatctatgcaccttattgttctatgataaatttcctcttattattataaatcatctgaatcgtgacggcttatggaatgcttcaaatagtacaaaaacaaatgtgtactataagactttctaaacaattctaaccttagcattgtgaacgagacataagtgttaagaagacataacaattataatggaagaagtttgtctccatttatatattatatattacccacttatgtattatattaggatgttaaggagacataacaattataaagagagaagtttgtatccatttatatattatatactacccatttatatattatacttatccacttatttaatgtctttataaggtttgatccatgatatttctaatattttagttgatatgtatatgaaagggtactatttgaactctcttactctgtataaaggttggatcatccttaaagtgggtctatttaattttattgcttcttacagataaaaaaaaaattatgagttggtttgataaaatattgaaggatttaaaataataataaataacatataatatatgtatataaatttattataatataacatttatctataaaaaagtaaatattgtcataaatctatacaatcgtttagccttgctggacgaatctcaattatttaaacgagagtaaacatatttgactttttggttatttaacaaattattatttaacactatatgaaatttttttttttatcagcaaagaataaaattaaattaagaaggacaatggtgtcccaatccttatacaaccaacttccacaagaaagtcaagtcagagacaacaaaaaaacaagcaaaggaaattttttaatttgagttgtcttgtttgctgcataatttatgcagtaaaacactacacataacccttttagcagtagagcaatggttgaccgtgtgcttagcttcttttattttatttttttatcagcaaagaataaataaaataaaatgagacacttcagggatgtttcaaatttaaatcctgcagg

SEQ ID NO: 416 - DNA, 10374 bp, Artificial Sequence
  synthesized DNA fragment
ttaattaataatgtataagcattaaattaaagatactagaatcaattttgtaattataaacgtaattaaatcttaaatcttcgaggttagaccttcaggaaatagagatgcttgcagaagatcccgacgtctgcgatcgcgacgtcctagaatctaattattctattcagactaaattagtataagtatttttttaatcaataaataataattaataatttattagtaggagtgattgaatttataatatattttttttaatcatttaaagaatcttatatctttaaattgacaagagttttaaatggggagagtgttatcatatgacaagtaggattaatgtgttatagtttcacatgcattacgataagttgtgaaagataacattattatatataacaatgacaatcactagcgatcgagtagtgagagtcgtcttattacactttcttccttcgatctgtcacatggcggcggcccgaattctcatcaccaccactcgaaatcattgaaggacacctgatcatcagaggagcccacgtaagcatgatcctctggagtcatagaagaggtggcctggtggtgctgaagatcagtagtgagatccatgaggtcgtttgggattgggtagtggtcgttaaggttgccgatgagcatagcaatggaggcctcttcttcatctcttgggatgtagtcgagcatggcctcttcgtaatgattcctctcacgagactcgttctcacgaccctcattctgcttaccggagtttccgttcatggcgaagtagaggttcttggactcgtcctcatagatagtgaggaagtcgccgatctcagcaccgttttgcttcacgaactcaccagtgttctcgagcacgtacatcctggacttgttgttggaccagaacttgtacttgaaggaccaggactgcatagagaacacgtccctcatctgaacgacgatgccctctttgtcagagagctttggaaggttggcctcagcatctctctttggaagcacaattcttccgagggatcccacatcggagttcttgagttctttctcgcagagcaccctgagtttcttgttgtcgaaagtggactgctggtaggagtccttcttgtcggagatctgcacgttgttcttgaggttgagcatcatgagctgcctcttagaatccacaagctcggatggtgaagagtttggggaggagttgttacgggacctcatcatggcgttcttacggttgatcctggccatcttagtcatccttgggtcaagaaatcctcccctctcttgccaaaggcatgggtttccaacaagagatccgaactcggatccagtctgagtcactggaatctgtgggtagcactctgagaggtacactggctgtggattcataacagcagccatctgctcaacggggtaagagaatggtggaaggaagtgatgaggctgagcctggtgatgatcgtaagttggcacagtagtgaagtgggacctgttgttgttggggtccatggaaagctcttgcacagagttagcgttggaggatgggaatgggaggaagttgtccatggtgaattcgctagcggttgatgatgttggtgagactgagaaccttgggggtctttatatagatgttcagctatgcggggatgcgatcctggggtaggagagcacgtacggggccccgctcgtttgtggctctccgtgcggacatcccgtgcggacagtaccagaaagtgctccgtctctgctctatacggctctatacgcgtacctcttgaacggtgcgtggagaggagtggtgtgtcaatttccgccccgccctcgtgcggttccgcatgcatccaatcctaggtcggaactatcccgagctgcggatgccgatgcggacggacaagtgggaactatcacaactatcgagacgtcgcccgttcgactcagatcttccaaggcctcgtctccgagtccgctgcttctcgccgcgccgatcacttctccgccgccaacaaggcttgtagttaataggaatcattcagggattgtgattccgggcagtagtaattaataatatagtattagtatagataatatgtttcgtttgggatctttggaacgttgctctgttccttgttgttcattttaaagcttttgagggatagttgcagaactgttcggtgatgcttcatcctctcaagaactagatttgggtaaagaaacatccatgcatggatatggaatgttgttcttccgattggagattattttataaaatttaaaattcatgatttaaaaaaacacataaaaaccacaaaattcatgatttattgacaatacgatacaaaattagcaccaccggctactggctcattacacatttccccttcccctcattctcactttgtggctttattattattattattacatatattttaccgttattatttcacgtcacataagcttgactagtttagaggaagctgtcgacctttccgttgagtcccctctcaagatccttagccacgagagcagccatatcagacttacggccaaggaactggagagccctgatgcagtagttgcagttctgcctaagttgaaggtatccagcgagagcgtttccctgaccatcaagatcaaggcaatcgaggaggatgtaagcagccttagcaaatgagtggatgagcaccacagtccatggctcaacaaggaatgcaacctcagtaagggagtcgtggaagtgcctgtacattggagaagccttgcctggatcgagttcttggcctctaagagatgacctagcgagagcagacacagcaagagcgttatcaagcctgagcttagtcacgaggtcgatgtggttgatatcggagtaggaatccctgtcgatggactcgagcacatcagccaaaagcatagcagcaaggtgccagtgtccatcaaggatcacgtaccaagactggatcctggatgggagaagctcatggttggcaacgcaatcctgcatgaatggctggtacttagcagtccagtggttgtacacgtagagagtcctctgaatagcagcctcaagcctagctggagaagctcccctatacaacaaagtctggagctgagtcacacgcctgtaaagcaacaccttaacaggagtagcagaggagagagcagcagcagcttgttcataagtgcatggccacctagcagctggttgagaaatttgagtgtgggactcgtggtcgggcaaagaatcagaagtcctaaggaacaggtcgccccacacatcagacttctcttgattagatgggacctgccttggtggctcccagcaatcaaggttaataggagtctcggcacctcttcttggtggagaagcagaagagatctgggagtcctcatcggacacaacaagtggcctctggtacatagcagcagacagagtgtcgaacatgatcccgagccagaacatgagagacagagtagacctgtgttcctcagaagccaccactggatcaagttgtggagactcagatgagggggtgggagtctcgaaaattccagcgaaagtagaagccacggatccaccaggaagcctattgaaagccttaccccttctctgcatcctagcgaacttgtgcctgaaggtgtagagctgcctattagcagtctcgaggaacactggagcaccatcattctcgagaagcttatcgagcctagctcccattccatgttgctcatcatcatcgagcacggactgagtgaggctgaagatgatgttggcgaagatcaccctgaaggatgggattccagtagtgtgctgaagtgcatgcctagcctcattccaagcgttacgcctaatagaacgctcgtcagcagcaatatcagctgggacgttaagtccagctcccctttgagcatgttgagtccactgagaagcgaaagccacaatagcaaggtgaagtgccctagcagcagccttatcttcttcagcggagagagcccttcctctaagagaagttgacaccctatcgagcctgcacaccctaatgcacatcctgttagaccaatttggtccccactcagccctttgctttggtgggaggtaagaaatctggtcggagtatgggcagttgtgctcagtaagccagcaagaaagggcgttttccatggagtcgtggtagatcctcatgaggttcttggtcatggtggacctagcataccttctagcggtagagtcggaagccatgcacaaactgttttctgggaggagtggagactgcctatcagaccaaagagagccatcctgagcaacttgctgaacggagttagtgtcagtcacggaatctggatcggtagtctgttcctcaagctcacgaatgagatcatcagtgtttggggagtgtggtggaagaagaacagcctggaaagacaatggggagaggggcttctcaagttgctgtcccatagagaaatcgcctgggatagcaagatcccatgggaatggagcatcagattgcacgttagcagcatcctcagcgttagctggaatagcagaatgggagaagtcgaagagatcgccagggtgagaaagaagtccctgagtccaagatggcaaagcatcgtgggagttgatcactggtggagcatcgtgattatcggactcgggagttggaatagtagcagcggaagtagaaggctcggaggtagtagtagcagtcctagccttcttagtcctagctcttggagcagcacccttagccttagacctttgggagctaagccagttgaaggtgcagtccttgttccacctcttgcagttagagcatgacacccatccgttctcattagcctcgttacggttctctggagcatcacatcttctcttgcccttacggcatgggtcacaagagtggttctgccttcttctagtgtcggccatggtactagtactcattattaaaacaaacataaacatattattataaaaactaaaaacattacaaacttacaaatttctctgaagttgtatcctcagtacttcaaagaaaatagcttacaccaaattttttcttgttttcacaaatgccgaacttggttccttatataggaaaactcaagggcaaaaatgacacggaaaaatataaaaggataagtagtgggggataagattcctttgtgataaggttactttccgcccttacattttccaccttacatgtgtcctctatgtctctttcacaatcaccgaccttatcttcttcttttcattgttgtcgtcagtgcttacgtcttcaagattcttttcttcgcctggttcttctttttcaatttctacgtattcttcttcgtattctggcagtataggatcttgtatctgtacattcttcatttttgaacataggttgcatatgtgccgcatattgatctgcttcttgctgagctcacataatacttccatagtttttcccgtaaacattggattcttgatgctacatcttggcccgggtcgatagttgtgatagttcccacttgtccgtccgcatcggcatccgcagctcgggatagttccgacctaggattggatgcatgcggaaccgcacgagggcggggcggaaattgacacaccactcctctccacgcaccgttcaagaggtacgcgtatagagccgtatagagcagagacggagcactttctggtactgtccgcacgggatgtccgcacggagagccacaaacgagcggggccccgtacgtgctctcctaccccaggatcgcatccccgcatagctgaacatctatataaagacccccaaggttctcagtctcaccaacatcatcaaccgctagcgggcccaccatgaagaagcgactcactacctccacttgctccagctctccatcttcctctgtgtcctcttccactaccacctctagcccaattcaatctgaggctccaagacctaagagggccaagagagctaagaaatcctctccatccggcgacaagtctcacaacccaacttctccagcttccacccgtaggtcatctatctacagaggtgttactaggcacaggtggactggaaggtttgaggctcatctctgggacaagtccagctggaactccatccaaaacaagaagggcaagcaggtttacctcggcgcttacgattctgaagaggctgctgctcacacttacgatcttgctgctcttaagtactgggggccagacactattctcaacttcccagctgagacttacaccaaagaactcgaagagatgcagagggtgaccaaagaagagtacctcgcttctctcaggcgtcagtcatctggattttctaggggcgtgtcaaagtacaggggagttgctaggcatcatcacaatggaagatgggaggctaggatcggaagggtgttcggaaacaagtacctctacctcggcacctacaacacccaagaagaggcagctgctgcttacgacatggctgctattgagtacaggggtgctaacgctgtgaccaacttcgacatctccaactacatcgacaggctcaagaaaaagggcgtgttcccattcccagtgaaccaggctaatcaccaagagggaatcctcgtcgaagctaagcaagaggttgagactcgtgaggccaaagaggaacctagggaagaggttaagcagcagtacgttgaggaaccacctcaagaagaggaagaaaaagaggaagagaaggccgagcaacaagaggctgagattgtgggatattccgaagaggccgctgttgtgaactgctgcatcgactcctccaccatcatggaaatggataggtgcggcgacaacaacgagcttgcttggaatttctgcatgatggacaccggcttctccccattccttactgatcagaacctcgccaacgagaacccaattgagtaccccgagcttttcaacgagctggctttcgaggataacatcgacttcatgttcgacgacggaaagcacgagtgccttaaccttgagaacctcgattgctgtgtggtgggaagagaatccccaccctcttcatcttcaccactcagctgcctttctaccgactccgcttcttccactactactaccactacctccgtgtcctgcaactacctcgtgtaagggcccgccgccatgtgacagatcgaaggaagaaagtgtaataagacgactctcactactcgatcgctagtgattgtcattgttatatataataatgttatctttcacaacttatcgtaatgcatgtgaaactataacacattaatcctacttgtcatatgataacactctccccatttaaaactcttgtcaatttaaagatataagattctttaaatgattaaaaaaaatatattataaattcaatcactcctactaataaattattaattattatttattgattaaaaaaatacttatactaatttagtctgaatagaataattagattctagcccgggcctgcaggcatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagagaacacgggggacttctagaaccatggctatcctcgactccgctggtgtgactactgttactgaaaatggtggtggcgagttcgtggatcttgatagacttaggcgtaggaagtccaggtccgattcttctaacggacttctcctctccggctccgataacaactctccatctgatgatgttggggctccagctgatgtgagggataggattgattccgtggtgaacgatgatgctcagggcactgctaatctcgctggtgataacaatggtggcggagataacaacggtggtggaagaggtggtggtgagggaagaggtaatgctgacgctactttcacctacaggccatctgttccagctcatagaagggctagagagagccctctttcctccgatgctatcttcaagcagtctcacgctggactcttcaacctttgcgtggtggtgcttatcgctgtgaactccaggctcattatcgagaacctgatgaagtacggctggctcatcaggaccgatttctggttctctagccgttctcttagggactggccactctttatgtgctgcatctccctcagcattttcccactcgctgctttcactgttgagaagcttgtgctccagaagtacatctctgagcccgtggtgattttcctccacatcatcatcaccatgaccgaggtgctctacccagtgtacgttacacttaggtgcgactccgctttcctctctggtgtgactcttatgctcctcacttgcatcgtgtggctcaagcttgtttcctacgctcacacctcctacgacattcgttctcttgctaacgctgccgacaaggctaatcccgaagtgtcttactacgtgtcccttaagtccctcgcctactttatggtggctccaactctttgctaccagccatcttatccaaggtccgcctgtattaggaagggatgggttgcaaggcagttcgctaagctcgtgatcttcactggattcatgggcttcattatcgagcagtacatcaaccccatcgtgaggaactctaagcaccctcttaagggcgatctcctctacgctattgagagggtgttgaagctctctgtgccaaacctttacgtgtggctctgcatgttctactgctttttccacctctggctcaatatcctcgctgagcttctttgcttcggcgacagagagttctacaaggattggtggaacgctaagtccgtgggcgattattggaggatgtggaacatgccagtgcacaagtggatggtgaggcacatctactttccatgcctcaggtccaagatcccaaagaccctcgctatcattatcgcattcctcgtgtctgctgtgttccacgagttgtgcattgctgttccatgccgacttttcaagctctgggctttcctcggaatcatgttccaggttccactcgtgttcatcaccaactacctccaagagaggttcggctccactgttggcaacatgattttctggttcatcttctgcatcttcggccagccaatgtgcgtgttgttgtactaccacgacctcatgaaccgtaagggctccatgtcttaatctagaaggggtgatcgattatgagatcgtacaaagacactgctaggtgttaaggatggataataataataataatgagatgaatgtgttttaagttagtgtaacagctgtaataaagagagagagagagagagagagagagagagagagagagagagagagagagaggctgatgaaatgttatgtatgtttcttggtttttaaaataaatgaaagcacatgctcgtgtggttctatcgaattattcggcggttcctgtgggaaaaagtccagaagggccgccgcagctactactacaaccaaggccgtggaggagggcaacagagccagcacttcgatagctgctgcgatgatcttaagcaattgaggagcgagtgcacatgcaggggactggagcgtgcaatcggccagatgaggcaggacatccagcagcagggacagcagcaggaagttgagaggtggtcccatcaatctaaacaagtcgctagggaccttccgggacagtgcggcacccagcctagccgatgccagctccaggggcagcagcagtctgcatggttttgaagtggtgatcgatgagatcgtataaagacactgctaggtgttaaggatgggataataagatgtgttttaagtcattaaccgtaataaaaagagagagaggctgatggaatgttatgtatgtatgtttcttggtttttaaaattaaatggaaagcacatgctcgtgtgggttctatctgcaggcggccgcggcgcc

SEQ ID NO: 417 - DNA, 434 bp, Artificial Sequence
  hpRNAi
gtgagcaatgaaccaagatttatcaataccgttacttttgatagcaaagagggttctcctactcttgttatggtccacggatatggtgcctctcagggtttcttctttcggaatttttatgcccttgcgaggcatttcaaagttattgctattgatcagcttggctggggtggttcaagcaggcctgacttcacatgcagaagtacagaagagactgaagattggtttattgattcctttgaggagtggcgcaaagccaaaaaccttagcaactttattttgcttgggcactcctttggagggtatgtcgctgcaaaatatgctctcaagcatccagagcatgttcagcagttgattctggtaggaccagctggatttacatcagagactgaacatatgtccgagcggcttacccagtttagagcaacatggaa

SEQ ID NO: 418 - DNA, 593 bp, Artificial Sequence
  hpRNAi
actgctgatgctgtcaggcagtatctatggttgtttgaggagcataatgttcttgaattcctcgtacttgctggagatcatctatatcgaatggattatgaaaagttcattcaagcccacagagaaacagatgctgatattactgttgccgcactgccaatggatgaaaagcgagccactgcatttggtctcatgaagattgacgaagaaggacgcattattgaatttgcagagaaaccgaaaggagagcaattgaaagcaatgaaagtggatactaccattttaggtcttgatgatgagagagctaaagagatgccttttatcgcaagtatgggtatatatgtcattagcaaagatgtgatgttaaacttacttcgtgataagttccctggtgccaatgattttggcagtgaagttattcctggtgcaacttcgcttgggatgagagtgcaagcttatttatatgatggatactgggaagatattggtaccatcgaagctttctacaatgccaatttgggcattaccaaaaagccagtcccagattttagcttctatgaccgatcagctccaatctacacccaacctcgata

SEQ ID NO: 419 - protein, 5 aa, Artificial Sequence
  lipase motif
  misc_feature (2)..(2): Xaa can be any naturally occurring amino acid
  misc_feature (4)..(4): Xaa can be any naturally occurring amino acid
GXSXG

SEQ ID NO: 420 - protein, 6 aa, Artificial Sequence
  acyltransferase motif
  X (2)..(5): any amino acid
HXXXXD

SEQ ID NO: 421 - protein, 7 aa, Artificial Sequence
  probable lipid binding motif
  X (2)..(4): any amino acid
VXXXHGF

SEQ ID NO: 422 - DNA, 1224 bp, Arabidopsis thaliana
atggcggaagaaatctcaaagacgaaggtgggatcttcttctactgcttcggtggctgattcatctgctgctgcgtcggctgcaacgaatgcggccaaatcaagatggaaaattttgtggcctaattcgctccggtggattcctacgtccaccgattacatcatcgccgccgagaaacgtcttctctccatcctcaagacgccttatgtacaagagcaagtcagtattggttcaggaccaccaggttctaaaatcaggtggtttaggtctacgagcaatgagtcacgttacatcaacactgttacatttgatgccaaggagggagctcctacactcgtcatggttcatggttatggtgcttctcaagggtttttcttccgtaattttgatgctcttgccagtcgatttagagtgatcgctattgatcaacttgggtggggtggttcaagtaggcctgattttacatgtagaagcacagaagaaactgaggcatggtttatcgactcctttgaggaatggcgtaaagcccagaatctcagtaactttattctattaggacattcttttggaggctatgttgctgctaaatacgcgcttaagcatcctgaacatgttcaacacttaattctggtgggatctgctgggttctcagcagaagcagatgccaaatcagaatggctcactaaatttagagcaacatggaaaggtgcagtcctaaatcatttatgggagtcaaatttcactcctcagaagctggttagaggattaggtccttggggtccaggtcttgtaaatcggtatacaactgcaagatttggtgcacattcggagggaactgggctaacagaagaggaagccaaattgctaaccgattatgtgtaccatactttggctgcaaaggctagtggagagttatgcttgaaatacatcttctcatttggagcatttgctaggaagcccctcttacaaagtgcatcagagtggaaagtgccaacaacgtttatctatggaatgaatgattggatgaactatcaaggtgcggtggaagcgaggaaatccatgaaggtcccttgcgaaatcattcgggttccacagggtggtcattttgtgttcatagacaacccaattggttttcattctgcagtgctttatgcttgccgcaagtttatatctcaagactcctctcatgatcaacaactcctagatggtctacgattggtttag

SEQ ID NO: 423 - DNA, 1700 bp, Brachypodium distachyon
tccgcgcccgaaacgatcccaacagaagctctaatctccaaagccgccgcgcgtgttgagggtggtgcggggaaaagcttggtgtcgtgagcccccgtgtcgcatgcgccgcgctgccgccgtgacgaggatggcagcgaccgaggagatgaggcaggcgtccgccgccgccgccgccacggtgaccgaggcctcggcgtcggcggccccgcccgcggggtccaggtgggcgcgggtgtggccggccgcgctgcgctggatccccacctccaccgagcgcatcatcgccgccgagaagcgcctcctctccgtactcaaaactgggtatgtccaagaacaagttaacattggctcggctccacccgggtcaaaagtaagatggtttagatcatcaagtgatgagccaaggttcatcaatacagtgacatttgatagcaaggagaatgctcccactcttgtcatggtccatggttatggtgcttcacagggtttcttctttagaaattttgatgcccttgcaagccgtttccgagtgattgccattgatcagcttggttggggtggatcaagtagacctgacttcacctgtaaaagtaccgaagaaactgaggcttggttcatagattctttagaggaatggcgtaaagcaaagaacctcagtaattttatattgctcggtcattctttcggaggatatgttgcagcaaaatatgccttgcagcatcctgaacacgtgcagcacttaattttggtcggttctgctgggttttcatcagaaacagatcatagctctgagtggttaaccaagtttcgagcaacatggaaaggcatgctagtgaaccaactatgggagtccaattttactcctcaaagaattgtaagaggattgggtccttggggcccagatttggttcgcagatataccactgctaggtttggctcatattcaacaggtgaattactaacagaacatgagtccggcttgctgacagattacatttaccatacattagctgccaaagctagtggagagctgtgcttgaaatatattttttccttgggggcatttgcaaggaaacctcttctgcagagtgcatctgactggaaagtgccgaccactttcatatatggccatgacgattggatgaaataccagggggcacagcaagcacgcaaggatatgaaagttccttgcgaaatcatcagagtcccacagggaggacattttgtgttcatagataacccttccgggttccattcggcagtcttctatgcgtgccggaaatttttatctggagatgcagaggagggtctctctcttcctgatggcctgatatctgcatgacagcatgaggcgcgatgtcataccaattagcggtatgaacacaaagcaaagctatacggagctaggaaatgttacaaatgtcacgactcaccagaaatgttacaaatgtcaccactcaccagtttcctttttgtatgtatgaattgtgtgaatatacacgtcattcatatttgccggcgtatcagtacttcaatagtgataaaacatgatcatatatatatgtatgatttctctagtcggttctcatcaagtcaagttattgtgattggtgaatgatatactttccaggtcaactttgtgtttgcatgtacaaactatcatggaacatatcagtatagtttatgatttgtcttcc

SEQ ID NO: 424 - DNA, 1484 bp, Glycine max
gtcatggatgcgcgtcactgctcgcgttcattataatggcggaagagataaccaagaacgacgtcggagtaacctccaaaaccaccagaagcagctccaggttctggcctcgttggattcccacttccaccgatcacatcatcgctgccgagaagcgccttctttccgtcgtcaagactggttatgttcaagagcatgttaacattggctctggtcctcctggctccaaagtgaggtggttccgttcatccagcaacgagccgcggtttattaacaccgttacatttgacagtaaaccccattctccaacgcttgtcatgattcatggttatgctgcttcacaggggttcttttttcgcaattttgacgcgcttgcgtctcgatttagagtcattgctgttgatcaacttggatggggtggatcgagcagacctgatttcacatgcaaaagcactgaagaaactgaggcatggtttattgattcttttgaggaatggagaaaagccaaaaacttgagcaattttatactgctcggacattcttttggtggttatgttgctgccaaatatgcgctcaagcaccctgagcatgtacaacacttgattctggttggatctgctggattttcatctgaatcagatgcaaagtctgagtggataacaaggtttcgagcaacatggaagggggcagttttgaaccatctttgggaatcaaatttcacacctcagaaacttgtcaggggtttaggtccttggggtcccaacatagtccgcaagtatacaagtgctaggtttggtacacattcaactggggaaatactgactgaagaggaatcaacattgctgacagactatgtttaccacacattggcggccaaagctagtggagagctgtgcttaaaatatattttttcatttggagcatttgctaggatgccccttcttctcagtgcctcagagtggaaggtgcccaccactttcatgtatggtttccaagactggatgaattatcaaggtgcccaagaagctcgcaagcatatgaaggttccatgcgaaatcatcaggattcctcagggtgggcactttgcgttcattgacaacccaactgccttccattcagctgttttttatgcttgtcgaaggtttcttacacctgatccagacaatgaatctcttcctaaagggctaacctctgcataggttaggtcttaattttgtgctattcctgtctatatgtattttaatatttttttttactaattaaatttcataattgaatgaaatcatatgtatattgtttcagtaaagtggaatttactgaaaatatttgtaatagcaacttcaacaaaaatcgatttgtaggagaaatttcttccctggaaattgttctattttaaatcttgttgctcataagatattatgacttcattcaactaataattcatgtcgtttaggaaaagtagttagttatattaaatttgtcaa

SEQ ID NO: 425 - DNA, 1662 bp, Zea mays
accatacgggcggggccgcaccgaccgaacctaaccgagagcacgagcatacccgtcccgactccgactgcagagcatcagccgaggagaaaagtcgggagaaacgcgcgtgacgtctgcccgcgtcgtatgcgccgcgctgccgtcgccgcgacgacgacgacgaccaggatggcagccgaggagatgagacgggcctccgcctcaacggccacggcggagatgccggcgtcgccggcgccggcgcaagcggggtcgaggtgggcgcgggtgtggccgcgcgcgctccggtggatccccacctccacggaccgcatcatcgccgccgagaagcgactcctcacgatagtcaaaactggatatgtccaggaacgagtcaacattggctctgctccacctgggtcaaaagtaagatggtttaggtcagcaagtgatgaaccaaggttcattaatactgtaacatttgatagcaaggagaatgcccccaccctggttatggtccatggctatggagcttcacaggggttcttctttcgaaactttgatgcccttgcaagccgttttagggtgattgccattgatcagcttggctggggtggttcaagcagacctgacttcacatgtaaaagtaccgaagaaactgaggcatggttcatagattctttcgaggagtggcgcaaggccaagaacctcagtaattttatattgcttggtcactcttttggaggatatgttgctgcaaaatatgcgctaaagcaccctgaacacgttcaacagttgattttggttggtcctgctggcttctcatcagaaacagagcatagctctgagtggttaaccaagtttcgagcaacatggaaaggcatgctaatgaatcgtctttgggagtccaattttactccccaaagggttattaggggattgggtccttggggtccaggtctagtacagagatataccagtgccaggtttggtacaagttctactggtgaattactaacagatgaagaatcggcattgatgacagattatatgtaccatacgttagctgccaaagctagtggagagctgtgcttgaaatatatattttccttcggggcatttgcaaggaaacctcttctgcagtgcgcgtccgattggaaagtgccgactactttcatatatgggcagcaagattggatgaactaccaaggcgctcagcaagcacggaaggacatgaaagttccttgtgaaataatcagggtgccgcagggtggacattttgtgttcatagacaacccttcagggttccactcggctgtcttctatgcgtgccgtaatcttctatcagtaaatggagaggagggattcacatttcctgatggcctaatatctgcgtgaagtggcatgttcaacaagcttgctcaacaacagtttacataaagcaaagatatacgattgtggaaatcattgcccatttccaccaatttgcttgtatacggattatgctgtgtatatattacataacaaatgtattagtatcatttaatgcacgatttgtgaaagggcctgagtttgtatttagcgaattttaggttggtttttttccctttttcttctttcagtgcgcttgctagtcaatcccatactataagccgtgatcatttaaaaaaaaaaaaaaaa

SEQ ID NO: 426 - DNA, 1763 bp, Sorghum bicolor
actgcagatgcgcggtcgtcggctccggctcgcggaggcgagaacggcgaaccagcccgtgtctctgttccctttcttccctttaaaaacacggcaaaaaaaaagctagccggttacgctaccgaaccgaacggctcggcacgcgggcacgggcgcggggtcgcaccggaaaagcacgagcagagcagacctgacgtctccagactgcaggagcatcatcagtcgaggaggaggaagtgtgggggggggaaagggaaacgtgcgcgtcgtatgcgcctcgctgccgtcgccaggacgaccaggatggcagccgaggagatgaggcgggcctcggcctccgcggcggtcgcggccacgacggaggcggcgccggcgccggcgcaagcggggtccaggtgggcgcgggtgtggccgagcgcgctccggtggatccccacctccacggatcgcatcatcgccgcggagaagcggctcctctcgatagtcaaaactgggtatgtccaggaacaagtcaacattggctcagctccacctgggtcaaaagtaagatggtttaggtcagcgagtgatgaaccaaggttcattaatactgtaacatttgatggcaaggagaacgcccccaccctggttatggtccatggctatggagcttcacaggggttcttctttcgaaactttgacgcccttgcaagtcgttttagggtgattgccattgatcagcttggctggggtggttcaagcagacctgacttcacatgtaaaagtaccgaagaaactgaggcatggttcatagattcttttgaggagtggcgcaaggccaagaacctcagtaattttatattgcttggtcactcctttggaggatatgttgcggcaaagtatgccctaaagcaccctgaacacattcagcacttagttttggttggtcctgctggcttctcgtcagaaacagaccatagctctgagtggttaaccaagtttcgagcaacatggaaaggcatgctagtgaatcatctttgggagtccaattttactccccaaagagttattagaggattgggcccttggggtccaggtctagtacaaagatataccagtgccaggtttggtacacgttcaactggtgatatactaacagatcaagaatcaacattgttgacagattatatttaccataccttagctgccaaagctagtggagagctgtgcttgaaatatatattttccttcggggcatttgcaaggaaacctcttctgcagtgcgcatccgattggaaagtgccgactactttcatatatggtcaggaagattggatgaactaccaaggggctcagcaagcacggaaggacatgaaagttccttgtgaaataatcagggtgccacagagtggacattttgtgtttatagacaacccttcagggttccactcggctgtcttctacgcgtgccgtaatcttttatcccaaaatggggaggagggcttcacatttcctggtggcctaatatctgcatgaagtggcatgttcaacaatcttatcgtgcccaacaatagtttatatgaagcaaagatatacgatggtggaaatctttgctcatttccaccaatctggaaatatttgtgccctcttccaccaatttgtttgtatacggattatgccgtgtatatattctgtgttgactgtaagaaacataatgtattaacattatgtaatgtatgtacgattctttatttgattttcaacttgcaatacgcaagaaccac

SEQ ID NO: 427 - DNA, 1399 bp, Ricinus communis
cgcctttttaccagtcaatttccatttttatatataagtgcttttgcttaatttaagactaactacagcgacgaattcgcgtttatgaaattgcttcgcctacgactgctacgagtatctagctcctcaatatcatcaataatggcggaaggggctgctgccacatcagcatcagcatcagcgtcagcgtcagcgtcatgggcaaaaacaagatctctacggccatctgctctccgttggatcccaacttcaaccgatcacatcatcgccgccgaaaagcgtcttctctccctcgtcaagactccctatgttgtggaacaagtgaatatagggtctggcccaccggggtcgaaggtgaggtggtttcgttctaaaagcgacgaggcacggtttattaacacggttacttttgatagcaaagaggaggattctcctacactggttatggttcatggatatgctgcttctcaaggcttcttctttcgcaattttgatgctcttgcttctcgtttcaggctcattgctattgatcagctcggttggggtggatcaagtagacctgattttacgtgtaagagcactgaagaaactgaggcatggttcattgactcctttgaggcttggcgtaaagagaaaaacctcagtaacttcatcttacttggacattctttcggagggtatattgcagctaaatatgcactcaagcatcctgagcatgttcaacatctgattttagtgggatctgctggattttcatcagaatctgaagacaaatctgagcagcttactcggttcagagcaacatggaagggagcagttttgaatcatttatgggagtctaattttactcctcagaaggttattagaggtttaggtccttggggtccagatctcgtacgcaagtacacaactgctagatttggttcatattcaactggtgagatattaaaggaggaggagtccaaattgcttacagactatgtgtaccataccttagccgccaaagctagtggagagctatgcttgaaatatatattttcttttggagcatttgctcggatgccccttctacaaagcgcgtcacaatggaaagtgccaactactttcatatatgggatgcaagattggatgaattatcaaggggcccaaagagctcgcaaagatatgaatgtcccatgtgaaatcattagggttcctcagggcgggcacttcgttttcatagacaacccaactgggtttcattcagctgtgttatatgcctgccggagatttctctcacccgatcctgataatgaatctcttcctgaaggtctgatatctgcgtaggaagtgtggtttgtaattatttcttttttatttgttgtgtataatttatctgagaatttccaattctttcaat

SEQ ID NO: 428 - DNA, 1480 bp, Medicago truncatula
ggttggctcatagttccttttacctgttgaaaacaaaacatatggagtaacattttagtcagaaattcaaagctacgcacttgattaaactaattatcgaaaaatggcggaagaaattagacaaaaggacgacgtcgattcatcttcgaaatctaaaagcttctggtcttcactccgttggattcccacttctaccgatcatatcatcgccgctgagaaacgccttctttccattatcaagactgggtatgctcaagagcatgttaatataggttctggtcctcctggctctaaagttagatggttccgttcaaccagtaacgagccacgctttctcaacactgttacatttgatagtaaacccgattctcctacacttgttatggttcatggatacgctgcttctcagggtttcttctttcgcaattttgatgctctcgcctctcgtttcagaatcattgctgttgatcaacttggttggggaggatcaagcagacctgatttcacatgcaaaagtaccgaagaaactgaggcatggttcattgattctttcgaggaatggagaaaagccaaaaatcttaccaatttcatactgcttggacattcttttggtggttatgttgcttccaaatacgcgctcaagcaccctcagcacgtacaacacttaattttggtgggacctgccgggtttacagaagaaacagatccaaagactgagtttgttactaagtttcgagcaacatggaagggagcagttctgaaccatctatgggaatctaattttacacctcagaaaattgtcagaggtttaggtccttggggtcctaacatggtccgcaaatatacaagtgctaggtttggtacacattcaaccgggcaaaaactgattgacgaggaatcaagtctgctgactgattatgtttatcatacattggcggccaaagctagtggggagctgtgtttaaaatatatttttgcatttggagcatttgctaggatgccccttcttcaaagtgctcaagagtggaaggtgcccaccacattcatatatggttacgaagattggatgaattatgaaggtgcccaagaagctcgcaagcatatgaaggttccatgtgaaattatcagggtccctaaggccggccattttgtgttcattgacaacccaagtggcttccattcagctgtgttttatgcttgtcgaaggtttcttaccccaaattcggacaatgaatctcttcccgaagggctatcgtctgcttaggatttaattttgcatcaatccagtgtatattaatatggttattaatttttttttacttcataactgaatgaagccgtgtcttgtttctcagtgaagtggaatataatggaaatatatgtaattgtaataacaataatattgatttgttggggaactttgaggacaaaaacatattctggtaaaattttgttgcacatgcgacaaacatatgctgtg

SEQ ID NO: 429 - protein, 407 aa, Arabidopsis thaliana
MAEEISKTKVGSSSTASVADSSAAASAATNAAKSRWKILWPNSLRWIPTSTDYIIAAEKRLLSILKTPYVQEQVSIGSGPPGSKIRWFRSTSNESRYINTVTFDAKEGAPTLVMVHGYGASQGFFFRNFDALASRFRVIAIDQLGWGGSSRPDFTCRSTEETEAWFIDSFEEWRKAQNLSNFILLGHSFGGYVAAKYALKHPEHVQHLILVGSAGFSAEADAKSEWLTKFRATWKGAVLNHLWESNFTPQKLVRGLGPWGPGLVNRYTTARFGAHSEGTGLTEEEAKLLTDYVYHTLAAKASGELCLKYIFSFGAFARKPLLQSASEWKVPTTFIYGMNDWMNYQGAVEARKSMKVPCEIIRVPQGGHFVFIDNPIGFHSAVLYACRKFISQDSSHDQQLLDGLRLV

SEQ ID NO: 430 - protein, 413 aa, Brachypodium distachyon
MRRAAAVTRMAATEEMRQASAAAAATVTEASASAAPPAGSRWARVWPAALRWIPTSTERIIAAEKRLLSVLKTGYVQEQVNIGSAPPGSKVRWFRSSSDEPRFINTVTFDSKENAPTLVMVHGYGASQGFFFRNFDALASRFRVIAIDQLGWGGSSRPDFTCKSTEETEAWFIDSLEEWRKAKNLSNFILLGHSFGGYVAAKYALQHPEHVQHLILVGSAGFSSETDHSSEWLTKFRATWKGMLVNQLWESNFTPQRIVRGLGPWGPDLVRRYTTARFGSYSTGELLTEHESGLLTDYIYHTLAAKASGELCLKYIFSLGAFARKPLLQSASDWKVPTTFIYGHDDWMKYQGAQQARKDMKVPCEIIRVPQGGHFVFIDNPSGFHSAVFYACRKFLSGDAEEGLSLPDGLISA

SEQ ID NO: 431 - protein, 387 aa, Glycine max
MAEEITKNDVGVTSKTTRSSSRFWPRWIPTSTDHIIAAEKRLLSVVKTGYVQEHVNIGSGPPGSKVRWFRSSSNEPRFINTVTFDSKPHSPTLVMIHGYAASQGFFFRNFDALASRFRVIAVDQLGWGGSSRPDFTCKSTEETEAWFIDSFEEWRKAKNLSNFILLGHSFGGYVAAKYALKHPEHVQHLILVGSAGFSSESDAKSEWITRFRATWKGAVLNHLWESNFTPQKLVRGLGPWGPNIVRKYTSARFGTHSTGEILTEEESTLLTDYVYHTLAAKASGELCLKYIFSFGAFARMPLLLSASEWKVPTTFMYGFQDWMNYQGAQEARKHMKVPCEIIRIPQGGHFAFIDNPTAFHSAVFYACRRFLTPDPDNESLPKGLTSA

SEQ ID NO: 432 - protein, 416 aa, Zea mays
MRRAAVAATTTTTRMAAEEMRRASASTATAEMPASPAPAQAGSRWARVWPRALRWIPTSTDRIIAAEKRLLTIVKTGYVQERVNIGSAPPGSKVRWFRSASDEPRFINTVTFDSKENAPTLVMVHGYGASQGFFFRNFDALASRFRVIAIDQLGWGGSSRPDFTCKSTEETEAWFIDSFEEWRKAKNLSNFILLGHSFGGYVAAKYALKHPEHVQQLILVGPAGFSSETEHSSEWLTKFRATWKGMLMNRLWESNFTPQRVIRGLGPWGPGLVQRYTSARFGTSSTGELLTDEESALMTDYMYHTLAAKASGELCLKYIFSFGAFARKPLLQCASDWKVPTTFIYGQQDWMNYQGAQQARKDMKVPCEIIRVPQGGHFVFIDNPSGFHSAVFYACRNLLSVNGEEGFTFPDGLISA

SEQ ID NO: 433 - protein, 414 aa, Sorghum bicolor
MRLAAVARTTRMAAEEMRRASASAAVAATTEAAPAPAQAGSRWARVWPSALRWIPTSTDRIIAAEKRLLSIVKTGYVQEQVNIGSAPPGSKVRWFRSASDEPRFINTVTFDGKENAPTLVMVHGYGASQGFFFRNFDALASRFRVIAIDQLGWGGSSRPDFTCKSTEETEAWFIDSFEEWRKAKNLSNFILLGHSFGGYVAAKYALKHPEHIQHLVLVGPAGFSSETDHSSEWLTKFRATWKGMLVNHLWESNFTPQRVIRGLGPWGPGLVQRYTSARFGTRSTGDILTDQESTLLTDYIYHTLAAKASGELCLKYIFSFGAFARKPLLQCASDWKVPTTFIYGQEDWMNYQGAQQARKDMKVPCEIIRVPQSGHFVFIDNPSGFHSAVFYACRNLLSQNGEEGFTFPGGLISA

SEQ ID NO: 434 - protein, 413 aa, Ricinus communis
MKLLRLRLLRVSSSSISSIMAEGAAATSASASASASASWAKTRSLRPSALRWIPTSTDHIIAAEKRLLSLVKTPYVVEQVNIGSGPPGSKVRWFRSKSDEARFINTVTFDSKEEDSPTLVMVHGYAASQGFFFRNFDALASRFRLIAIDQLGWGGSSRPDFTCKSTEETEAWFIDSFEAWRKEKNLSNFILLGHSFGGYIAAKYALKHPEHVQHLILVGSAGFSSESEDKSEQLTRFRATWKGAVLNHLWESNFTPQKVIRGLGPWGPDLVRKYTTARFGSYSTGEILKEEESKLLTDYVYHTLAAKASGELCLKYIFSFGAFARMPLLQSASQWKVPTTFIYGMQDWMNYQGAQRARKDMNVPCEIIRVPQGGHFVFIDNPTGFHSAVLYACRRFLSPDPDNESLPEGLISA

SEQ ID NO: 435 - protein, 386 aa, Medicago truncatula
MAEEIRQKDDVDSSSKSKSFWSSLRWIPTSTDHIIAAEKRLLSIIKTGYAQEHVNIGSGPPGSKVRWFRSTSNEPRFLNTVTFDSKPDSPTLVMVHGYAASQGFFFRNFDALASRFRIIAVDQLGWGGSSRPDFTCKSTEETEAWFIDSFEEWRKAKNLTNFILLGHSFGGYVASKYALKHPQHVQHLILVGPAGFTEETDPKTEFVTKFRATWKGAVLNHLWESNFTPQKIVRGLGPWGPNMVRKYTSARFGTHSTGQKLIDEESSLLTDYVYHTLAAKASGELCLKYIFAFGAFARMPLLQSAQEWKVPTTFIYGYEDWMNYEGAQEARKHMKVPCEIIRVPKAGHFVFIDNPSGFHSAVFYACRRFLTPNSDNESLPEGLSSA

SEQ ID NO: 436 - protein, 371 aa, Oryza sativa
MAAEGMSTAAAAAEATATAAPAAGSRWGRAWPSALRWIPTSTDRIIAAEKRLLSIVKTGYVQEQVNIGSSPPGSKVRWFRSSSDEPRFINTVTFDSEENAPTLVMVHGYGASQGFFFRNFDALASRFRVIAIDQLGWGGSSRPDFTCKSTEETEAWFIDSFEEWRKAKNLSNFILLGHSFGGYVAAKYALQHPEHVQHLILVGPAGFSSETEHSSEWLTKFRATWKGMLVNHLWESNFTPQRIVRGLGPWGPGLVQRYTSARFGSHSTGELLTEQESTLLTDYIYHTLAAKASGELCLKHIFSFGAFARKPLLQRSYEHPGDLESICTIGGHFVFIDNPSGFHSAVFHACRKFLSGDGEEGLSLPEGLTSA

SEQ ID NO: 437 - DNA, 1317 bp, Arabidopsis thaliana
gatctctctccctctctctctctctctctccgggaaaaatggataacttcttaccctttccctcttctaacgcaaactctgtccaagaactctctatggatcctaacaacaatcgctcgcacttcacaacagtccctacttatgatcatcatcaggctcagcctcatcacttcttgcctccgttttcatacccggtggagcagatggcggcggtgatgaatcctcagccggtttacttatcggagtgttatcctcagatcccggttacgcaaaccggaagtgaattcggttctctggttggtaatccttgtttgtggcaagagagaggtggttttcttgatccgcgtatgacgaagatggcaaggatcaacaggaaaaacgccatgatgagatcaagaaacaactctagccctaattctagtccaagtgagttggttgattcaaagagacagctgatgatgcttaacttgaaaaataacgtgcagatctccgacaagaaagatagctaccaacagtccacatttgataacaagaagcttagggttttgtgtgagaaggaattgaagaacagcgatgttgggtcactcgggaggatagttctaccaaagagagatgcagaagcaaatcttccgaagctatctgataaagaaggaatcgttgtacagatgagagatgttttctctatgcagtcttggtctttcaaatacaagttttggtccaataacaagagcagaatgtatgtcctcgagaacacaggagaatttgtgaagcaaaatggagctgagataggagactttttaacaatatacgaggacgaaagcaagaatctctacttcgccatgaatggaaattcgggaaaacaaaatgaaggaagagaaaatgagtcgagggaaaggaaccactacgaagaggcaatgcttgattacataccaagagacgaagaggaagcttccattgcaatgctcatcggaaatctaaacgatcactatcccatccctaacgatctcatggacctcaccactgaccttcagcaccatcaagccacgtcctcatcaatgccacctgaggatcacgcgtacgtgggttcatccgatgatcaggtgagctttaacgactttgagtggtggtgatatggtggtggaagttctcaagttcataaccccctttatgaaaatagaccttaagatatacaaaagagattaaaagaaaaaaaagttagtatatttcatcatatctctcattgaagatgagatttatatctataattgtttaatagtgtttttattacttttctatcaatatattaaagttttaatt

SEQ ID NO: 438 - DNA, 1439 bp, Medicago truncatula
tttcatccttacatattttgcatattgaaacacgtaggatggaataagattgataacaaaaattgcattgtttgcatattgaaaacatgggacaattgcatgggttcatgtgcttcattataagccacacattaggaaacacaggttgatattcaccactatttaacataagaatatctcatgtgtaagcattcatacaaatatcacaattgaattaaaaaccaaagaaatgtcttcctctaacttctcttgtatcctatccatctccttaacattcttcatcttgctactgaacaaggtgaattcagcagaaacaacttccttttccatcacaaaatttgtcccagatcaaaagaatctcatcttccaaggcgatgcgaaaactgcctcaacagggaagttagaactctccaaggcagtcaagaactctattggtagagctctttattccgcccctattcacatttgggatagcaaaaccggtagtgtggctaactttcaaactaccttcacctttacaataacggcgcctaatacttataatgttgcagacggtcttgcattcttcattgcaccaattgatactaagccgaaatcaattcatcatggaggataccttggagttttcgatagcaaaacttacaaaaaatcaattcaaactgttgcagttgaaattgacactttctataatgctcaatgggatccaaatcccggaaatataagtagcactggtcgacatattggaatcgatgtaaactctatcaaatcaataagcaccgtgccgtggagtttggaaaacaataaaaaggctaatgttgcgatagggtttaatggtgcaacaaatgtgttgagtgttgatgtggaatatcctttgattcgtcattataccctaagtcatgttgtgcctttgaaggatgttgttcctgagtgggtaaggattggtttctcttcttctactggagccgaatattcagcacatgatattttatcgtggtcttttgattcaaagttgaacctaggttttgagaacaatatcaatgccaatgtttcaagctctactcaagctgcatagttgaaaacttatccattatgtatgtgtgagtgtaaccaaccagtctaagaaaactataataagatacctgaaataatggttcattatcgtgtagtagaaatatggtcacaccatatcttcttttttttttaataaattatggaataatgctatttctcgcgagagttatgtttcggaaagattcatgaatagatgttaatcaattagatctatatatatatatatatatatatatatatatatatatatagcattttcttaaattatgcatatgtaatatcgtgtaatgctattgtttatatcaatgaatggtgttttgtagtcacataattcgtaatttctctccatgagaacagcgaaccaatta

SEQ ID NO: 439 - DNA, 1393 bp, Brassica napus
gagatgggtatccctataaggtgcagcatcgaaccatctgcaacattttgactcgttttcttttgtgtttttataacatctgtctcttcttcactcgatctccctctcttttctttttcaatctccccaacgaacctcccttcataactctctttctctccccgggaaatatggataacttcttgcccttttcctcttctaacgcaaactctgtccaagaactctccatggatcttaacaagaatcgctcgcacttctccatggcgcagcctcagcacttgttgccgccttactcgtacgttgcatgtccggcacttgatcagacggggaccatgaatcatcagcctcttcactcatcggatgcttttcctcagatcccggttgtacaaaccggaggtgaattcggctatttggtttgtaagcccggtgtgaggcaggaacgaggtggatttcttgatccacactccactaagatggctaggatcaacaggaagaaggcgatgctaagatcaagaaacaactctaaccctaattctagttcgaatgagttggttgattcaaggagacaagtggctcttaccatgaaaaataatgccgagattgctgctagaaaagatttttatcgattctcctcattcgataacaagaaacttagggttttgttggtgaagcacttgaagaacagcgatgttgggtcacttggaaggattgttctaccaaagagagaagcagaaggaaatcttccggagctatctgataaagaaggaatggtattagagatgagagatgttgactctgtgcagtcttggtctttcaaatacaagtactggtccaataacaagagcagaatgtatgtcctcgaaaacacaggagaatttgtgaagaaaaatggagtattgatgggagactatctaacaatctacgaggacgaaagcaagaatctctacttctccatcagaaagcacccacacaaacaaaatgatggaagagaggatgagtcgatggaagttatcgagatgaacttctatgaagatataatgtttgattacataccaaatgatgaagacgattccattgcaatgctcctcggaaatctaaacgagcactatccctacccaaatgatcttatggatctcactgtcaatcttgatcagcatcagcaagccacctcctcgtcgccacctgctgatcacatgagctcgaacgatttcttatggtgatgtgatggacgttgatatggattccctttgagatgatatacaagggatgaaaagaaaagagtatcatattcatatccatatttgtttgataaaatgtgtttgttcccaatctattatttatgaaaaacttatttgtgtttaactccagattaattaaatatttttcatttgac

SEQ ID NO: 440 - DNA, 1755 bp, Arabidopsis thaliana
atgaactcgatgaataactggttaggcttctctctctctcctcatgatcaaaatcatcaccgtacggatgttgactcctccaccaccagaaccgccgtagatgttgccggagggtactgttttgatctggccgctccctccgatgaatcttctgccgttcaaacatcttttctttctcctttcggtgtcaccctcgaagctttcaccagagacaataatagtcactcccgagattgggacatcaatggtggtgcatgcaataacattaacaataacgaacaaaatggaccaaagcttgagaatttcctcggccgcaccaccacgatttacaataccaacgagaccgttgtagatggaaatggcgattgtggaggaggagacggtggtggtggcggctcactaggcctttcgatgataaaaacatggctgagtaatcattcggttgctaatgctaatcatcaagacaatggtaacggtgcacgaggcttgtccctctctatgaattcatctactagtgatagcaacaactacaacaacaatgatgatgtcgtccaagagaagactattgttgatgtcgtagaaactacaccgaagaaaactattgagagttttggacaaaggacgtctatataccgcggtgttacaaggcatcggtggacaggtagatacgaggcacatttatgggacaatagttgcaaaagagaaggccagactcgcaaaggaagacaagtttatctgggaggttatgacaaagaagaaaaagcagctagggcttacgatttagccgcactaaagtattggggaaccaccactactactaacttccccttgagtgaatatgagaaagaggtagaagagatgaagcacatgacgaggcaagagtatgttgcctctctgcgcaggaaaagtagtggtttctctcgtggtgcatcgatttatcgaggagtaacaaggcatcaccaacatggaaggtggcaagctaggatcggaagagtcgccggtaacaaagacctctacttgggaactttcggcacacaggaagaggctgctgaggcttatgacattgcagccattaaattcagaggattaagcgcagtgactaacttcgacatgaacagatacaatgttaaagcaatcctcgagagcccgagtctacctattggtagttctgcgaaacgtctcaaggacgttaataatccggttccagctatgatgattagtaataacgtttcagagagtgcaaataatgttagcggttggcaaaacactgcgtttcagcatcatcagggaatggatttgagcttattgcagcaacagcaggagaggtacgttggttattacaatggaggaaacttgtctaccgagagtactagggtttgtttcaaacaagaggaggaacaacaacacttcttgagaaactcgccgagtcacatgactaatgttgatcatcatagctcgacctctgatgattctgttaccgtttgtggaaatgttgttagttatggtggttatcaaggattcgcaatccctgttggaacatcggttaattacgatccctttactgctgctgagattgcttacaacgcaagaaatcattattactatgctcagcatcagcaacaacagcagattcagcagtcgccgggaggagattttccggtggcgatttcgaataaccatagctctaacatgtactttcacggggaaggtggtggagaaggggctccaacgttttcagtttggaacgacacttag

SEQ ID NO: 441 - DNA, 2061 bp, Medicago truncatula
atgaacttgttaggtttctctctatctccacaagaacaacatccatcaacacaagatcaaacggtggcttcccgttttgggttcaaccctaatgaaatctcaggctctgatgttcaaggagatcactgctatgatctctcttctcacacaactcctcatcattcactcaacctttctcatcctttttccatttatgaagctttccacacaaataacaacattcacaccactcaagattggaaggagaactacaacaaccaaaacctactattgggaacatcatgcatgaaccaaaatgtgaacaacaacaaccaacaagcacaaccaaagctagaaaacttcctcggtggacactctttcaccgaccatcaagaatacggtggtagcaactcatactcttcattacacctcccacctcatcagccggaagcatcctgtggcggtggtgatggtagtacaagtaacaataactcaataggtttatctatgataaaaacatggctcagaaaccaaccaccaccaccagaaaacaacaacaataacaacaatgaaagtggtgcacgtgtgcagacactatcactttctatgagtactggctcacagtcaagttcatctgtgcctcttctcaatgcaaatgtgatgagtggtgagatttcctcatcggaaaacaaacaaccacccacaactgcagttgtacttgatagcaaccaaacaagtgtcgttgaaagtgctgtgcctagaaaatccgttgatacatttggacaaagaacttccatttaccgtggtgtaacaaggcatagatggacagggagatatgaagctcacctttgggataatagttgtagaagagaggggcagactcgcaaaggaaggcaagtttacttgggaggttatgacaaagaagaaaaagcagctagagcctatgatttggcagcactaaaatattggggaacaactactacaacaaattttccaattagccattatgaaaaagaagtggaagaaatgaagcatatgacaaggcaagagtacgttgcgtcattgagaaggaaaagtagtggtttttcacgaggtgcatccatttaccgaggagtaacaagacatcatcaacatggtagatggcaagctaggattggaagagttgcaggcaacaaagatctctacctaggaactttcagcactcaagaagaggcagcagaggcatatgatgtggcagcaataaaattcagaggactgagtgcagttacaaactttgacatgagcagatatgatgtcaaaaccatacttgagagcagcacattaccaattggtggtgctgcaaagcgtttaaaagacatggagcaagttgaattgaatcatgtgaatgttgatattagccatagaactgaacaagatcatagcatcatcaacaacacttcccatttaacagaacaagccatctatgcagcaacaaatgcatctaattggcatgcactttcattccaacatcaacaaccacatcatcattacaatgccaacaacatgcagttacagaattatccttatggaactcaaactcaaaagctttggtgcaaacaagaacaagattctgatgatcatagtacttatactactgctactgatattcatcaactacagttagggaataataataacaatactcacaatttctttggtttacaaaatatcatgagtatggattctgcttccatggataatagttctggatctaattctgttgtttatggtggtggagatcatggtggttatggaggaaatggtggatatatgattccaatggctattgcaaatgatggtaaccaaaatccaagaagcaacaacaattttggtgagagtgagattaaaggatttggttatgaaaatgtttttgggactactactgatccttatcatgcacaggcagcaaggaacttgtactatcagccacaacaattatctgttgatcaaggatcaaattgggttccaactgctattccaacacttgctccaaggactaccaatgtctctctatgtcctcctttcactttgttgcatgaatag

SEQ ID NO: 442 - protein, 363 aa, Arabidopsis thaliana
MDNFLPFPSSNANSVQELSMDPNNNRSHFTTVPTYDHHQAQPHHFLPPFSYPVEQMAAVMNPQPVYLSECYPQIPVTQTGSEFGSLVGNPCLWQERGGFLDPRMTKMARINRKNAMMRSRNNSSPNSSPSELVDSKRQLMMLNLKNNVQISDKKDSYQQSTFDNKKLRVLCEKELKNSDVGSLGRIVLPKRDAEANLPKLSDKEGIVVQMRDVFSMQSWSFKYKFWSNNKSRMYVLENTGEFVKQNGAEIGDFLTIYEDESKNLYFAMNGNSGKQNEGRENESRERNHYEEAMLDYIPRDEEEASIAMLIGNLNDHYPIPNDLMDLTTDLQHHQATSSSMPPEDHAYVGSSDDQVSFNDFEWW

SEQ ID NO: 443 - protein, 280 aa, Medicago truncatula
MSSSNFSCILSISLTFFILLLNKVNSAETTSFSITKFVPDQKNLIFQGDAKTASTGKLELSKAVKNSIGRALYSAPIHIWDSKTGSVANFQTTFTFTITAPNTYNVADGLAFFIAPIDTKPKSIHHGGYLGVFDSKTYKKSIQTVAVEIDTFYNAQWDPNPGNISSTGRHIGIDVNSIKSISTVPWSLENNKKANVAIGFNGATNVLSVDVEYPLIRHYTLSHVVPLKDVVPEWVRIGFSSSTGAEYSAHDILSWSFDSKLNLGFENNINANVSSSTQAA

SEQ ID NO: 444 - protein, 349 aa, Brassica napus
MDNFLPFSSSNANSVQELSMDLNKNRSHFSMAQPQHLLPPYSYVACPALDQTGTMNHQPLHSSDAFPQIPVVQTGGEFGYLVCKPGVRQERGGFLDPHSTKMARINRKKAMLRSRNNSNPNSSSNELVDSRRQVALTMKNNAEIAARKDFYRFSSFDNKKLRVLLVKHLKNSDVGSLGRIVLPKREAEGNLPELSDKEGMVLEMRDVDSVQSWSFKYKYWSNNKSRMYVLENTGEFVKKNGVLMGDYLTIYEDESKNLYFSIRKHPHKQNDGREDESMEVIEMNFYEDIMFDYIPNDEDDSIAMLLGNLNEHYPYPNDLMDLTVNLDQHQQATSSSPPADHMSSNDFLW

SEQ ID NO: 445 - protein, 584 aa, Arabidopsis thaliana
MNSMNNWLGFSLSPHDQNHHRTDVDSSTTRTAVDVAGGYCFDLAAPSDESSAVQTSFLSPFGVTLEAFTRDNNSHSRDWDINGGACNNINNNEQNGPKLENFLGRTTTIYNTNETVVDGNGDCGGGDGGGGGSLGLSMIKTWLSNHSVANANHQDNGNGARGLSLSMNSSTSDSNNYNNNDDVVQEKTIVDVVETTPKKTIESFGQRTSIYRGVTRHRWTGRYEAHLWDNSCKREGQTRKGRQVYLGGYDKEEKAARAYDLAALKYWGTTTTTNFPLSEYEKEVEEMKHMTRQEYVASLRRKSSGFSRGASIYRGVTRHHQHGRWQARIGRVAGNKDLYLGTFGTQEEAAEAYDIAAIKFRGLSAVTNFDMNRYNVKAILESPSLPIGSSAKRLKDVNNPVPAMMISNNVSESANNVSGWQNTAFQHHQGMDLSLLQQQQERYVGYYNGGNLSTESTRVCFKQEEEQQHFLRNSPSHMTNVDHHSSTSDDSVTVCGNVVSYGGYQGFAIPVGTSVNYDPFTAAEIAYNARNHYYYAQHQQQQQIQQSPGGDFPVAISNNHSSNMYFHGEGGGEGAPTFSVWNDT

SEQ ID NO: 446 - protein, 686 aa, Medicago truncatula
MNLLGFSLSPQEQHPSTQDQTVASRFGFNPNEISGSDVQGDHCYDLSSHTTPHHSLNLSHPFSIYEAFHTNNNIHTTQDWKENYNNQNLLLGTSCMNQNVNNNNQQAQPKLENFLGGHSFTDHQEYGGSNSYSSLHLPPHQPEASCGGGDGSTSNNNSIGLSMIKTWLRNQPPPPENNNNNNNESGARVQTLSLSMSTGSQSSSSVPLLNANVMSGEISSSENKQPPTTAVVLDSNQTSVVESAVPRKSVDTFGQRTSIYRGVTRHRWTGRYEAHLWDNSCRREGQTRKGRQVYLGGYDKEEKAARAYDLAALKYWGTTTTTNFPISHYEKEVEEMKHMTRQEYVASLRRKSSGFSRGASIYRGVTRHHQHGRWQARIGRVAGNKDLYLGTFSTQEEAAEAYDVAAIKFRGLSAVTNFDMSRYDVKTILESSTLPIGGAAKRLKDMEQVELNHVNVDISHRTEQDHSIINNTSHLTEQAIYAATNASNWHALSFQHQQPHHHYNANNMQLQNYPYGTQTQKLWCKQEQDSDDHSTYTTATDIHQLQLGNNNNNTHNFFGLQNIMSMDSASMDNSSGSNSVVYGGGDHGGYGGNGGYMIPMAIANDGNQNPRSNNNFGESEIKGFGYENVFGTTTDPYHAQAARNLYYQPQQLSVDQGSNWVPTAIPTLAPRTTNVSLCPPFTLLHE

SEQ ID NO: 447 - DNA, 336 bp, Artificial Sequence
  inducible promoter
tcgatagttgtgatagttcccacttgtccgtccgcatcggcatccgcagctcgggatagttccgacctaggattggatgcatgcggaaccgcacgagggcggggcggaaattgacacaccactcctctccacgcaccgttcaagaggtacgcgtatagagccgtatagagcagagacggagcactttctggtactgtccgcacgggatgtccgcacggagagccacaaacgagcggggccccgtacgtgctctcctaccccaggatcgcatccccgcatagctgaacatctatataaagacccccaaggttctcagtctcaccaacatcatcaacc

SEQ ID NO: 448 - DNA, 2466 bp, Artificial Sequence
  inducer
atggccgacactagaagaaggcagaaccactcttgtgacccatgccgtaagggcaagagaagatgtgatgctccagagaaccgtaacgaggctaatgagaacggatgggtgtcatgctctaactgcaagaggtggaacaaggactgcaccttcaactggcttagctcccaaaggtctaaggctaagggtgctgctccaagagctaggactaagaaggctaggactgctactactacctccgagccttctacttccgctgctactattccaactcccgagtccgataatcacgatgctccaccagtgatcaactcccacgatgctttgccatcttggactcagggacttctttctcaccctggcgatctcttcgacttctcccattctgctattccagctaacgctgaggatgctgctaacgtgcaatctgatgctccattcccatgggatcttgctatcccaggcgatttctctatgggacagcaacttgagaagcccctctccccattgtctttccaggctgttcttcttccaccacactccccaaacactgatgatctcattcgtgagcttgaggaacagactaccgatccagattccgtgactgacactaactccgttcagcaagttgctcaggatggctctctttggtctgataggcagtctccactcctcccagaaaacagtttgtgcatggcttccgactctaccgctagaaggtatgctaggtccaccatgaccaagaacctcatgaggatctaccacgactccatggaaaacgccctttcttgctggcttactgagcacaactgcccatactccgaccagatttcttacctcccaccaaagcaaagggctgagtggggaccaaattggtctaacaggatgtgcattagggtgtgcaggctcgatagggtgtcaacttctcttagaggaagggctctctccgctgaagaagataaggctgctgctagggcacttcaccttgctattgtggctttcgcttctcagtggactcaacatgctcaaaggggagctggacttaacgtcccagctgatattgctgctgacgagcgttctattaggcgtaacgcttggaatgaggctaggcatgcacttcagcacactactggaatcccatccttcagggtgatcttcgccaacatcatcttcagcctcactcagtccgtgctcgatgatgatgagcaacatggaatgggagctaggctcgataagcttctcgagaatgatggtgctccagtgttcctcgagactgctaataggcagctctacaccttcaggcacaagttcgctaggatgcagagaaggggtaaggctttcaataggcttcctggtggatccgtggcttctactttcgctggaattttcgagactcccaccccctcatctgagtctccacaacttgatccagtggtggcttctgaggaacacaggtctactctgtctctcatgttctggctcgggatcatgttcgacactctgtctgctgctatgtaccagaggccacttgttgtgtccgatgaggactcccagatctcttctgcttctccaccaagaagaggtgccgagactcctattaaccttgattgctgggagccaccaaggcaggtcccatctaatcaagagaagtctgatgtgtggggcgacctgttccttaggacttctgattctttgcccgaccacgagtcccacactcaaatttctcaaccagctgctaggtggccatgcacttatgaacaagctgctgctgctctctcctctgctactcctgttaaggtgttgctttacaggcgtgtgactcagctccagactttgttgtataggggagcttctccagctaggcttgaggctgctattcagaggactctctacgtgtacaaccactggactgctaagtaccagccattcatgcaggattgcgttgccaaccatgagcttctcccatccaggatccagtcttggtacgtgatccttgatggacactggcaccttgctgctatgcttttggctgatgtgctcgagtccatcgacagggattcctactccgatatcaaccacatcgacctcgtgactaagctcaggcttgataacgctcttgctgtgtctgctctcgctaggtcatctcttagaggccaagaactcgatccaggcaaggcttctccaatgtacaggcacttccacgactcccttactgaggttgcattccttgttgagccatggactgtggtgctcatccactcatttgctaaggctgcttacatcctcctcgattgccttgatcttgatggtcagggaaacgctctcgctggataccttcaacttaggcagaactgcaactactgcatcagggctctccagttccttggccgtaagtctgatatggctgctctcgtggctaaggatcttgagaggggactcaacggaaaggtcgacagcttcctctaa

The invention claimed is:

1. A process for producing an industrial product, the process comprising the steps of:
   i) obtaining a vegetative plant part comprising one or more exogenous polynucleotides which encode at least Wrinkled 1 (WRI1) and diacylglycerol acyltransferase (DGAT), wherein co-expression of WRI1 and DGAT has an effect on non-polar lipid accumulation in the vegetative plant part that is larger than an additive effect of the individual effects of each WRI1 and DGAT expressed alone,
   ii) either
      a) converting at least some of the lipid in the vegetative plant part of step i) to the industrial product by applying heat, chemical, or enzymatic means, or any combination thereof, to the lipid in situ in the vegetative plant part, or
      b) physically processing the vegetative plant part of step i), and subsequently or simultaneously converting at least some of the lipid in the processed vegetative plant part to the industrial product by applying heat, chemical, or enzymatic means, or any combination thereof, to the lipid in the processed vegetative plant part, and
   iii) recovering the industrial product, thereby producing the industrial product.

2. The process of claim 1, wherein the step of physically processing the vegetative plant part comprises one or more of rolling, pressing, crushing or grinding the vegetative plant part.

3. The process of claim 1, which prior to step ii) further comprises the steps of:
   (a) extracting at least some of the non-polar lipid content from the vegetative plant part as non-polar lipid, and
   (b) recovering the extracted non-polar lipid.

4. The process of claim 3, wherein
   (i) the extracted non-polar lipid comprises triacylglycerols, wherein the triacylglycerols comprise at least 90% (w/w) of the extracted non-polar lipid, and/or
   (ii) the extracted non-polar lipid comprises free sterols, steroyl esters, steroyl glycosides, waxes or wax esters, or any combination thereof.

5. The process of claim 3, wherein step (a) uses an organic solvent.

6. The process of claim 3 which comprises one or more of
   a) recovering the extracted non-polar lipid by collecting it in a container,
   b) one or more of degumming, deodorising, decolourising, drying or fractionating the extracted non-polar lipid,
   c) removing at least some waxes and/or wax esters from the extracted non-polar lipid, and
   d) analysing the fatty acid composition of the extracted non-polar lipid.

7. The process of claim 3 in which the volume of the extracted non-polar lipid is at least 1 liter.

8. The process of claim 1, wherein the industrial product is a hydrocarbon product such as fatty acid esters, preferably fatty acid methyl esters and/or a fatty acid ethyl esters, an alkane such as methane, ethane or a longer-chain alkane, a mixture of longer chain alkanes, an alkene, a biofuel, carbon monoxide and/or hydrogen gas, a bioalcohol such as ethanol, propanol, or butanol, biochar, or a combination of carbon monoxide, hydrogen and biochar.

9. The process of claim 1, wherein the vegetative plant part is an aerial plant part or a green plant part.

10. The process of claim 9, wherein the vegetative plant part is a plant leaf or stem.

11. The process of claim 1, further comprising a step of harvesting the vegetative plant part from a plant with a mechanical harvester.

12. The process of claim 11, wherein the vegetative plant part is harvested from the plant some time between about the time of flowering of the plant to about the time senescence of the plant has started.

13. The process of claim 1, wherein the vegetative plant part has one or more or all of the following features:
   i) oleic acid comprises at least 19% of the total fatty acid content in the non-polar lipid in the vegetative plant part,
   ii) palmitic acid comprises at least 20% of the total fatty acid content in the non-polar lipid in the vegetative plant part,
   iii) linoleic acid comprises at least 15% of the total fatty acid content in the non-polar lipid in the vegetative plant part, and iv) α-linolenic acid comprises less than 15% of the total fatty acid content in the non-polar lipid in the vegetative plant part.

14. The process of claim 1, in which at least some of the lipid is converted to the industrial product by chemical means, wherein
   i) the chemical means comprises reacting the non-polar lipid with an alcohol, optionally in the presence of a catalyst, to produce alkyl esters, and
   ii) optionally, blending the alkyl esters of step i) with petroleum based fuel.

15. The process of claim 14, wherein the alkyl esters are methyl esters.

16. The process of claim 1, wherein the industrial product is synthetic diesel fuel and the process comprises:
   i) converting the non-polar lipid in the vegetative plant part, or the processed vegetative plant part, to a syngas by gasification, and
   ii) converting the syngas to the synthetic diesel fuel in a process comprising using a metal catalyst or a microbial catalyst.

17. The process of claim 1, wherein the industrial product is a biofuel which is bio-oil or biogas, and the process comprises converting the non-polar lipid in the vegetative plant part or the processed vegetative plant part to the bio-oil by pyrolysis, or to the biogas by gasification or anaerobic digestion.

18. The process of claim 1, wherein the DGAT is DGAT1.

19. The process of claim 1, wherein the one or more exogenous polynucleotides further encode Oleosin.

20. The process of claim 18, wherein the one or more exogenous polynucleotides further encode Oleosin.

21. The process of claim 18, wherein the one or more exogenous polynucleotides further encode glycerol-3-phosphate acyltransferase (GPAT).

22. The process of claim 18, wherein the one or more exogenous polynucleotides further encode GPAT.

23. The process of claim 1, wherein the one or more exogenous polynucleotides further encode monoacylglycerol acyltransferase (MGAT).

24. The process of claim 18, wherein the one or more exogenous polynucleotides further encode monoacylglycerol acyltransferase (MGAT).

* * * * *